US012116397B2

(12) United States Patent
Feldwisch et al.

(10) Patent No.: US 12,116,397 B2
(45) Date of Patent: Oct. 15, 2024

(54) IL-1R-I BINDING POLYPEPTIDE

(71) Applicant: Swedish Orphan Biovitrum AB (publ), Stockholm (SE)

(72) Inventors: Joachim Feldwisch, Tyreso (SE); Malin Lindborg, Saltsjo-Boo (SE); Joakim Nilsson, Danderyd (SE); Erik Nordling, Danderyd (SE); Robert Svensson, Stockholm (SE)

(73) Assignee: Swedish Orphan Biovitrum AB (publ), Stockholm (SE)

( * ) Notice: Subject to any disclaimer, the term of this patent is extended or adjusted under 35 U.S.C. 154(b) by 709 days.

(21) Appl. No.: 16/498,186

(22) PCT Filed: Apr. 3, 2018

(86) PCT No.: PCT/EP2018/058448
§ 371 (c)(1),
(2) Date: Sep. 26, 2019

(87) PCT Pub. No.: WO2018/178392
PCT Pub. Date: Oct. 4, 2018

(65) Prior Publication Data
US 2021/0403533 A1 Dec. 30, 2021

(30) Foreign Application Priority Data

Mar. 31, 2017 (EP) ..................................... 17164226

(51) Int. Cl.
*A61K 38/16* (2006.01)
*C07K 14/715* (2006.01)
*C07K 14/79* (2006.01)
*A61K 38/00* (2006.01)

(52) U.S. Cl.
CPC .......... *C07K 14/7155* (2013.01); *C07K 14/79* (2013.01); *A61K 38/00* (2013.01); *C07K 2318/20* (2013.01); *C07K 2319/21* (2013.01); *C07K 2319/31* (2013.01)

(58) Field of Classification Search
CPC .... A61K 38/00; A61K 38/16; C07K 2318/20; C07K 2319/31; C07K 2319/00; C07K 14/7155
See application file for complete search history.

(56) References Cited

U.S. PATENT DOCUMENTS 9,808,502 B2    11/2017   Berghard et al.
2009/0155283 A1*  6/2009   Drew ..................... A61K 47/60
                                                      424/143.1

FOREIGN PATENT DOCUMENTS

| JP | 2007-537700 B2 | 12/2007 |
| JP | 2009-519011 A | 5/2009 |
| JP | 2010-530220 B2 | 9/2010 |
| JP | 2015-508652 A | 3/2015 |
| JP | 2016-006050 A | 1/2016 |
| WO | WO 2007/063308 A2 | 6/2007 |
| WO | WO 2009/077175 A1 | 6/2009 |
| WO | WO 2011/110515 A1 | 9/2011 |
| WO | WO 2013/126006 A1 | 8/2013 |
| WO | WO 2014/064237 A1 | 5/2014 |
| WO | WO 2014/140366 A1 | 9/2014 |
| WO | WO 2016/113246 A1 | 7/2016 |

OTHER PUBLICATIONS

Checco et al. Targeting diverse protein-protein interaction interfaces with α/β-peptides derived from the Z-domain scaffold. Proc Natl Acad Sci U S A, Apr. 14, 2015, 112 (15): 4552-4557.*
International Search Report and Written Opinion mailed Jun. 11, 2018 in connection with PCT/EP2018/058448.
Grimm et al., Selection and characterisation of affibody molecules inhibiting the interaction between Ras and Raf in vitro. N Biotechnol. Dec. 31, 2010;27(6):766-73. doi: 10.1016/j.nbt.2010.07.016. Epub Jul. 30, 2010.
Gronwell et al., Selection and characterization of Affibody ligands binding to Alzheimer amyloid beta peptides. J Biotechnol. Jan. 30, 2007;128(1):162-83. Epub Sep. 27, 2006.
Nygren, Alternative binding proteins: affibody binding proteins developed from a small three-helix bundle scaffold. FEBS J. Jun. 2008;275(11):2668-76. doi: 10.1111/j.1742-4658.2008.06438.x. Epub Apr. 24, 2008. Review.
Löfblom et al., Affibody molecules: engineered proteins for therapeutic, diagnostic and biotechnological applications. FEBS Lett. Jun. 18, 2010;584(12):2670-80. doi: 10.1016/j.febslet.2010.04.014. Epub Apr. 11, 2010. PMID: 20388508.

* cited by examiner

Primary Examiner — Dong Jiang

(57) ABSTRACT

The present disclosure relates to a class of engineered polypeptides having a binding affinity for interleukin-1 receptor type-I (IL-1R-I) which comprise the binding motif (BM)    $EX_2X_3X_4X_5X_6X_7EIX_{10}X_{11}LPNLX_{16}RX_{18}QYX_{21}AFIX_{25}X_{26}LX_{28}D$. The present disclosure also relates to the use of such an IL-1R-I binding polypeptide as a therapeutic, prognostic and/or diagnostic agent.

25 Claims, 65 Drawing Sheets
Specification includes a Sequence Listing.

FIGURE 1A

| DESIGNATION | SEQUENCE | SEQ ID NO |
|---|---|---|
| Z12964 | VDAKYAKEAEDATMEIYNLPNLTRRQYVAFIIKLLDDPSQSSELLSEAKKLNDSQAPK | 1 |
| Z12933 | VDAKYAKEAKTAQIEIYDLPNLTRRQYVAFIRKLLDDPSQSSELLSEAKKLNDSQAPK | 2 |
| Z12922 | VDAKYAKEDEQAQLEIFNLPNLTRRQYTAFIRKLFDDPSQSSELLSEAKKLNDSQAPK | 3 |
| Z12941 | VDAKYAKEVLYAYWEIFALPNLTRKQYTAFIRKLMDDPSQSSELLSEAKKLNDSQAPK | 4 |
| Z12915 | VDAKYAKEVKWAHHEIFQLPNLTRKQYTAFIVKLFDDPSQSSELLSEAKKLNDSQAPK | 5 |
| Z12975 | VDAKYAKEAHNAQQEIYRLPNLTRRQYTAFIIKLLDDPSQSSELLSEAKKLNDSQAPK | 6 |
| Z12905 | VDAKYAKEARAAQGEIYALPNLTRRQYTAFIMKLLDDPSQSSELLSEAKKLNDSQAPK | 7 |
| Z12974 | VDAKYAKEADHAQQEIFALPNLTRRQYTAFIIKLLDDPSQSSELLSEAKKLNDSQAPK | 8 |
| Z12967 | VDAKYAKEAHRAQMEIFALPNLTRRQYTAFIRKLLDDPSQSSELLSEAKKLNDSQAPK | 9 |
| Z12912 | VDAKYAKEALLAQQEIFALPNLTRRQYTAFIRKLLDDPSQSSELLSEAKKLNDSQAPK | 10 |
| Z12910 | VDAKYAKEALSAQQEIFALPNLTRSQYTAFIRKLLDDPSQSSELLSEAKKLNDSQAPK | 11 |
| Z12895 | VDAKYAKEALSAQQEIFALPNLTRRQYTAFIRKLLDDPSQSSELLSEAKKLNDSQAPK | 12 |
| Z12884 | VDAKYAKEASLAQHEIFALPNLTRKQYTAFIRKLFDDPSQSSELLSEAKKLNDSQAPK | 13 |
| Z12920 | VDAKYAKEAVYARDEIYLLPNLTRKQYTAFIRKLLDDPSQSSELLSEAKKLNDSQAPK | 14 |
| Z12917 | VDAKYAKEARQAYAEIYLLPNLTRKQYTAFIRKLLDDPSQSSELLSEAKKLNDSQAPK | 15 |
| Z12961 | VDAKYAKEARSAYAEIYGLPNLTRRQYTAFIIKLLDDPSQSSELLSEAKKLNDSQAPK | 16 |
| Z12929 | VDAKYAKEQADAYAEIYSLPNLTRKQYVAFIRKLIDDPSQSSELLSEAKKLNDSQAPK | 17 |
| Z12911 | VDAKYAKEHEKAILEIFHLPNLTRRQYTAFIMKLLDDPSQSSELLSEAKKLNDSQAPK | 18 |
| Z12891 | VDAKYAKEQSQAYHEIFKLPNLTRRQYTAFIMKLLDDPSQSSELLSEAKKLNDSQAPK | 19 |
| Z15810 | VDAKYAKEVTDAQLEIFALPNLTRKQYTAFIRKLLDDPSQSSELLSEAKKLNDSQAPK | 20 |
| Z15811 | VDAKYAKEVEEAQMEIFELPNLTRKQYTAFIRKLLDDPSQSSELLSEAKKLNDSQAPK | 21 |
| Z15812 | VDAKYAKEVESAQMEIFYLPNLTRKQYTAFIRKLLDDPSQSSELLSEAKKLNDSQAPK | 22 |
| Z15813 | VDAKYAKEVDEAYMEIYRLPNLTRKQYTAFIRKLLDDPSQSSELLSEAKKLNDSQAPK | 23 |
| Z15814 | VDAKYAKELENAYMEIYLLPNLTRKQYTAFIRKLLDDPSQSSELLSEAKKLNDSQAPK | 24 |
| Z15815 | VDAKYAKELESAYMEIFNLPNLTRKQYTAFIRKLLDDPSQSSELLSEAKKLNDSQAPK | 25 |
| Z15816 | VDAKYAKEVEEAQMEIFGLPNLTRKQYTAFIRKLLDDPSQSSELLSEAKKLNDSQAPK | 26 |
| Z15817 | VDAKYAKETEDAQMEIFALPNLTRKQYTAFIRKLFDDPSQSSELLSEAKKLNDSQAPK | 27 |
| Z15818 | VDAKYAKEVEQAQMEIYNLPNLTRKQYTAFIRKLFDDPSQSSELLSEAKKLNDSQAPK | 28 |

FIGURE 1B

| | | |
|---|---|---|
| Z15819 | VDAKYAKEAYVAQMEIFALPNLTRRQYTAFIRKLLDDPSQSSELLSEAKKLNDSQAPK | 29 |
| Z15820 | VDAKYAKEAYNAQMEIFGLPNLTRKQYTAFIRKLLDDPSQSSELLSEAKKLNDSQAPK | 30 |
| Z15821 | VDAKYAKELEEAQMEIFYLPNLTRKQYTAFIRKLLDDPSQSSELLSEAKKLNDSQAPK | 31 |
| Z15822 | VDAKYAKEIEAAQMEIFTLPNLTRKQYTAFIRKLLDDPSQSSELLSEAKKLNDSQAPK | 32 |
| Z15823 | VDAKYAKEVEQAQMEIFALPNLTRRQYTAFIRKLLDDPSQSSELLSEAKKLNDSQAPK | 33 |
| Z15824 | VDAKYAKEIEEAQMEIFALPNLTRKQYTAFIRKLFDDPSQSSELLSEAKKLNDSQAPK | 34 |
| Z15825 | VDAKYAKETYNAQMEIFALPNLTRKQYTAFIRKLFDDPSQSSELLSEAKKLNDSQAPK | 35 |
| Z15826 | VDAKYAKEVERAQMEIFDLPNLTRKQYTAFIRKLFDDPSQSSELLSEAKKLNDSQAPK | 36 |
| Z15827 | VDAKYAKEIESAQMEIYYLPNLTRKQYTAFIRKLLDDPSQSSELLSEAKKLNDSQAPK | 37 |
| Z15828 | VDAKYAKEVHAAQMEIFYLPNLTRKQYTAFIRKLFDDPSQSSELLSEAKKLNDSQAPK | 38 |
| Z15829 | VDAKYAKETYEAQMEIFKLPNLTRKQYTAFIRKLLDDPSQSSELLSEAKKLNDSQAPK | 39 |
| Z15830 | VDAKYAKEIEDAYMEIYGLPNLTRKQYTAFIRKLLDDPSQSSELLSEAKKLNDSQAPK | 40 |
| Z15831 | VDAKYAKEAERAQMEIFDLPNLTRKQYTAFIRKLFDDPSQSSELLSEAKKLNDSQAPK | 41 |
| Z15832 | VDAKYAKEVEIAQMEIFYLPNLTRKQYTAFIRKLLDDPSQSSELLSEAKKLNDSQAPK | 42 |
| Z15833 | VDAKYAKEVEFAQMEIFKLPNLTRKQYTAFIRKLLDDPSQSSELLSEAKKLNDSQAPK | 43 |
| Z15834 | VDAKYAKEVITAQMEIFYLPNLTRKQYTAFIRKLLDDPSQSSELLSEAKKLNDSQAPK | 44 |
| Z15835 | VDAKYAKEIEEAQMEIYALPNLTRKQYTAFIRKLLDDPSQSSELLSEAKKLNDSQAPK | 45 |
| Z15836 | VDAKYAKETEAAQMEIFSLPNLTRKQYTAFIRKLLDDPSQSSELLSEAKKLNDSQAPK | 46 |
| Z15837 | VDAKYAKEIENAQMEIYYLPNLTRKQYTAFIRKLFDDPSQSSELLSEAKKLNDSQAPK | 47 |
| Z15839 | VDAKYAKETVEAYEEIFHLPNLTRKQYTAFIRKLLDDPSQSSELLSEAKKLNDSQAPK | 48 |
| Z15840 | VDAKYAKEVEVAQMEIFALPNLTRKQYTAFIRKLLDDPSQSSELLSEAKKLNDSQAPK | 49 |
| Z15841 | VDAKYAKEVEDAYMEIYALPNLTRKQYTAFIRKLLDDPSQSSELLSEAKKLNDSQAPK | 50 |
| Z15842 | VDAKYAKEIEVAQMEIFSLPNLTRKQYTAFIRKLLDDPSQSSELLSEAKKLNDSQAPK | 51 |
| Z15843 | VDAKYAKEVEQAQMEIFGLPNLTRKQYTAFIRKLLDDPSQSSELLSEAKKLNDSQAPK | 52 |
| Z15844 | VDAKYAKEVDQAYMEIYRLPNLTRKQYTAFIRKLLDDPSQSSELLSEAKKLNDSQAPK | 53 |
| Z15845 | VDAKYAKEVEDAQMEIFKLPNLTRKQYTAFIRKLLDDPSQSSELLSEAKKLNDSQAPK | 54 |
| Z15846 | VDAKYAKEIEEAQMEIFSLPNLTRKQYTAFIRKLLDDPSQSSELLSEAKKLNDSQAPK | 55 |
| Z15847 | VDAKYAKEVYVAQMEIFGLPNLTRKQYTAFIRKLFDDPSQSSELLSEAKKLNDSQAPK | 56 |
| Z15848 | VDAKYAKEIEEAQMEIFRLPNLTRKQYTAFIRKLFDDPSQSSELLSEAKKLNDSQAPK | 57 |

FIGURE 1C

| | | |
|---|---|---|
| Z15849 | VDAKYAKEVEHAQMEIFYLPNLTRKQYTAFIRKLLDDPSQSSELLSEAKKLNDSQAPK | 58 |
| Z15850 | VDAKYAKEIEIAQMEIFALPNLTRKQYTAFIRKLFDDPSQSSELLSEAKKLNDSQAPK | 59 |
| Z15851 | VDAKYAKEVVEAYQEIFQLPNLTRKQYTAFIRKLLDDPSQSSELLSEAKKLNDSQAPK | 60 |
| Z15852 | VDAKYAKEAEFAQMEIFELPNLTRRQYTAFIRKLLDDPSQSSELLSEAKKLNDSQAPK | 61 |
| Z15853 | VDAKYAKEVELAQMEIFGLPNLTRKQYTAFIRKLLDDPSQSSELLSEAKKLNDSQAPK | 62 |
| Z15854 | VDAKYAKEVEVAQMEIYGLPNLTRRQYTAFIRKLLDDPSQSSELLSEAKKLNDSQAPK | 63 |
| Z15855 | VDAKYAKEIESAQMEIFNLPNLTRKQYTAFIRKLLDDPSQSSELLSEAKKLNDSQAPK | 64 |
| Z15856 | VDAKYAKEVERAQFEIFALPNLTRKQYTAFIRKLFDDPSQSSELLSEAKKLNDSQAPK | 65 |
| Z15857 | VDAKYAKEVKEAQDEIFALPNLTRKQYTAFIRKLFDDPSQSSELLSEAKKLNDSQAPK | 66 |
| Z15858 | VDAKYAKEVEKAQMEIFNLPNLTRKQYTAFIRKLLDDPSQSSELLSEAKKLNDSQAPK | 67 |
| Z15859 | VDAKYAKEVEFAQMEIFRLPNLTRKQYTAFIRKLLDDPSQSSELLSEAKKLNDSQAPK | 68 |
| Z15860 | VDAKYAKEVEQAQMEIFALPNLTRRQYTAFIRKLFDDPSQSSELLSEAKKLNDSQAPK | 69 |
| Z15861 | VDAKYAKEVENAQMEIFALPNLTRKQYTAFIRKLLDDPSQSSELLSEAKKLNDSQAPK | 70 |
| Z15862 | VDAKYAKEVEIAQMEIFALPNLTRKQYTAFIRKLLDDPSQSSELLSEAKKLNDSQAPK | 71 |
| Z15863 | VDAKYAKEIESAQMEIFALPNLTRKQYTAFIRKLLDDPSQSSELLSEAKKLNDSQAPK | 72 |
| Z15864 | VDAKYAKEIENAQMEIFALPNLTRKQYTAFIRKLLDDPSQSSELLSEAKKLNDSQAPK | 73 |
| Z15865 | VDAKYAKEIEDAQMEIYYLPNLTRKQYTAFIRKLLDDPSQSSELLSEAKKLNDSQAPK | 74 |
| Z15866 | VDAKYAKELEKAQMEIYRLPNLTRKQYTAFIRKLFDDPSQSSELLSEAKKLNDSQAPK | 75 |
| Z15867 | VDAKYAKETYEAQMEIFALPNLTRKQYTAFIRKLLDDPSQSSELLSEAKKLNDSQAPK | 76 |
| Z15868 | VDAKYAKEVEWAQMEIFALPNLTRKQYTAFIRKLLDDPSQSSELLSEAKKLNDSQAPK | 77 |
| Z15869 | VDAKYAKEVQAAQYEIFALPNLTRKQYTAFIRKLLDDPSQSSELLSEAKKLNDSQAPK | 78 |
| Z15870 | VDAKYAKEVEYAQMEIFFLPNLTRKQYTAFIRKLLDDPSQSSELLSEAKKLNDSQAPK | 79 |
| Z15871 | VDAKYAKEVELAYFEIYALPNLTRKQYTAFIRKLLDDPSQSSELLSEAKKLNDSQAPK | 80 |
| Z15872 | VDAKYAKEVEVAQMEIFALPNLTRKQYTAFIRKLLDDPSQSSELLSEAKKLNDSQAPK | 81 |
| Z15873 | VDAKYAKEAEIAQMEIFALPNLTRKQYTAFIRKLLDDPSQSSELLSEAKKLNDSQAPK | 82 |
| Z15874 | VDAKYAKEVEKAYYEIFALPNLTRKQYTAFIRKLLDDPSQSSELLSEAKKLNDSQAPK | 83 |
| Z15875 | VDAKYAKELEDAYFEIYYLPNLTRKQYTAFIRKLLDDPSQSSELLSEAKKLNDSQAPK | 84 |
| Z15877 | VDAKYAKEVEEAQMEIFYLPNLTRKQYTAFIRKLLDDPSQSSELLSEAKKLNDSQAPK | 85 |
| Z15878 | VDAKYAKEAADAYQEIFQLPNLTRKQYTAFIRKLLDDPSQSSELLSEAKKLNDSQAPK | 86 |

FIGURE 1D

| | | |
|---|---|---|
| Z15879 | VDAKYAKEVEIAQMEIFGLPNLTRKQYTAFIRKLFDDPSQSSELLSEAKKLNDSQAPK | 87 |
| Z15880 | VDAKYAKEVEIAQMEIFSLPNLTRKQYTAFIRKLLDDPSQSSELLSEAKKLNDSQAPK | 88 |
| Z15881 | VDAKYAKEIEKAQMEIFRLPNLTRKQYTAFIRKLFDDPSQSSELLSEAKKLNDSQAPK | 89 |
| Z15882 | VDAKYAKEVEEAQMEIFGLPNLTRKQYTAFIRKLFDDPSQSSELLSEAKKLNDSQAPK | 90 |
| Z15883 | VDAKYAKETEIAQMEIFGLPNLTRKQYTAFIRKLFDDPSQSSELLSEAKKLNDSQAPK | 91 |
| Z15884 | VDAKYAKEIHDAQMEIFGLPNLTRKQYTAFIRKLFDDPSQSSELLSEAKKLNDSQAPK | 92 |
| Z15885 | VDAKYAKETEKAQMEIFGLPNLTRKQYTAFIRKLFDDPSQSSELLSEAKKLNDSQAPK | 93 |
| Z15886 | VDAKYAKEVERAQMEIFALPNLTRKQYTAFIRKLLDDPSQSSELLSEAKKLNDSQAPK | 94 |
| Z15887 | VDAKYAKEVKEAQMEIFVLPNLTRKQYTAFIRKLLDDPSQSSELLSEAKKLNDSQAPK | 95 |
| Z15888 | VDAKYAKEVEDAQMEIFSLPNLTRKQYTAFIRKLLDDPSQSSELLSEAKKLNDSQAPK | 96 |
| Z15889 | VDAKYAKEVEAAQMEIFSLPNLTRKQYTAFIRKLLDDPSQSSELLSEAKKLNDSQAPK | 97 |
| Z15890 | VDAKYAKEAEKAYFEIYELPNLTRKQYTAFIRKLLDDPSQSSELLSEAKKLNDSQAPK | 98 |
| Z15891 | VDAKYAKEIDKAYMEIFRLPNLTRKQYTAFIRKLLDDPSQSSELLSEAKKLNDSQAPK | 99 |
| Z15892 | VDAKYAKETEYAQMEIFNLPNLTRKQYTAFIRKLLDDPSQSSELLSEAKKLNDSQAPK | 100 |
| Z15893 | VDAKYAKEVEQAQMEIFHLPNLTRKQYTAFIRKLLDDPSQSSELLSEAKKLNDSQAPK | 101 |
| Z15894 | VDAKYAKEVEIAQMEIFILPNLTRKQYTAFIRKLLDDPSQSSELLSEAKKLNDSQAPK | 102 |
| Z15895 | VDAKYAKEIEQAQMEIFGLPNLTRKQYTAFIRKLLDDPSQSSELLSEAKKLNDSQAPK | 103 |
| Z15896 | VDAKYAKELDEAYMEIFGLPNLTRKQYTAFIRKLLDDPSQSSELLSEAKKLNDSQAPK | 104 |
| Z15897 | VDAKYAKETENAQMEIFALPNLTRKQYTAFIRKLLDDPSQSSELLSEAKKLNDSQAPK | 105 |
| Z15898 | VDAKYAKEVESAQMEIFGLPNLTRRQYTAFIRKLLDDPSQSSELLSEAKKLNDSQAPK | 106 |
| Z15899 | VDAKYAKEIENAQMEIFNLPNLTRKQYTAFIRKLFDDPSQSSELLSEAKKLNDSQAPK | 107 |
| Z15900 | VDAKYAKEVIDAQMEIFNLPNLTRKQYTAFIRKLLDDPSQSSELLSEAKKLNDSQAPK | 108 |
| Z15901 | VDAKYAKELYEAQMEIFALPNLTRKQYTAFIRKLLDDPSQSSELLSEAKKLNDSQAPK | 109 |
| Z15902 | VDAKYAKEVETAQMEIFGLPNLTRKQYTAFIRKLLDDPSQSSELLSEAKKLNDSQAPK | 110 |
| Z15903 | VDAKYAKEVEFAQMEIYALPNLTRRQYTAFIRKLLDDPSQSSELLSEAKKLNDSQAPK | 111 |
| Z15904 | VDAKYAKEVEEAQQEIFQLPNLTRKQYTAFIRKLLDDPSQSSELLSEAKKLNDSQAPK | 112 |
| Z15905 | VDAKYAKEVESAQMEIYNLPNLTRKQYTAFIRKLLDDPSQSSELLSEAKKLNDSQAPK | 113 |
| Z15906 | VDAKYAKETEQAQMEIFALPNLTRKQYTAFIRKLFDDPSQSSELLSEAKKLNDSQAPK | 114 |
| Z15907 | VDAKYAKELEAAYFEIYELPNLTRKQYTAFIRKLLDDPSQSSELLSEAKKLNDSQAPK | 115 |

FIGURE 1E

| ID | Sequence | # |
|---|---|---|
| Z15908 | VDAKYAKEVEEAYMEIYNLPNLTRRQYTAFIRKLLDDPSQSSELLSEAKKLNDSQAPK | 116 |
| Z15909 | VDAKYAKEVEVAYMEIYSLPNLTRKQYTAFIRKLLDDPSQSSELLSEAKKLNDSQAPK | 117 |
| Z15910 | VDAKYAKEIEQAQMEIFALPNLTRKQYTAFIRKLFDDPSQSSELLSEAKKLNDSQAPK | 118 |
| Z15911 | VDAKYAKEIEVAQMEIFALPNLTRKQYTAFIRKLLDDPSQSSELLSEAKKLNDSQAPK | 119 |
| Z15912 | VDAKYAKEVEAAQMEIFVLPNLTRKQYTAFIRKLLDDPSQSSELLSEAKKLNDSQAPK | 120 |
| Z15913 | VDAKYAKEVEAAQMEIYYLPNLTRKQYTAFIRKLLDDPSQSSELLSEAKKLNDSQAPK | 121 |
| Z15914 | VDAKYAKEVETAQLEIFALPNLTRKQYTAFIRKLLDDPSQSSELLSEAKKLNDSQAPK | 122 |
| Z15915 | VDAKYAKEAENAQMEIFSLPNLTRKQYTAFIRKLLDDPSQSSELLSEAKKLNDSQAPK | 123 |
| Z15916 | VDAKYAKEIERAQHEIFNLPNLTRKQYTAFIRKLFDDPSQSSELLSEAKKLNDSQAPK | 124 |
| Z15917 | VDAKYAKEVEEAQMEIFSLPNLTRKQYTAFIRKLFDDPSQSSELLSEAKKLNDSQAPK | 125 |
| Z15918 | VDAKYAKELEAAQMEIFSLPNLTRKQYTAFIRKLFDDPSQSSELLSEAKKLNDSQAPK | 126 |
| Z15919 | VDAKYAKEVVSAQMEIYALPNLTRKQYTAFIRKLLDDPSQSSELLSEAKKLNDSQAPK | 127 |
| Z15920 | VDAKYAKEVEDAQMEIYSLPNLTRKQYTAFIRKLLDDPSQSSELLSEAKKLNDSQAPK | 128 |
| Z15921 | VDAKYAKEVEEAQMEIFQLPNLTRKQYTAFIRKLFDDPSQSSELLSEAKKLNDSQAPK | 129 |
| Z15922 | VDAKYAKEIEKAQMEIFKLPNLTRKQYTAFIRKLFDDPSQSSELLSEAKKLNDSQAPK | 130 |
| Z15923 | VDAKYAKEIEKAQMEIFTLPNLTRKQYTAFIRKLFDDPSQSSELLSEAKKLNDSQAPK | 131 |
| Z15924 | VDAKYAKETYYAQMEIFALPNLTRKQYTAFIRKLLDDPSQSSELLSEAKKLNDSQAPK | 132 |
| Z15925 | VDAKYAKETYEAQMEIFELPNLTRKQYTAFIRKLLDDPSQSSELLSEAKKLNDSQAPK | 133 |
| Z15926 | VDAKYAKEIEEAQMEIFALPNLTRKQYTAFIRKLLDDPSQSSELLSEAKKLNDSQAPK | 134 |
| Z15927 | VDAKYAKEVQEAQMEIFALPNLTRKQYTAFIRKLFDDPSQSSELLSEAKKLNDSQAPK | 135 |
| Z15928 | VDAKYAKEIEEAQMEIFYLPNLTRKQYTAFIRKLLDDPSQSSELLSEAKKLNDSQAPK | 136 |
| Z15929 | VDAKYAKELEAAYMEIYYLPNLTRKQYTAFIRKLLDDPSQSSELLSEAKKLNDSQAPK | 137 |
| Z15930 | VDAKYAKETERAQMEIFALPNLTRKQYTAFIRKLLDDPSQSSELLSEAKKLNDSQAPK | 138 |
| Z15933 | VDAKYAKEIEHAQMEIFALPNLTRKQYTAFIRKLFDDPSQSSELLSEAKKLNDSQAPK | 139 |
| Z15935 | VDAKYAKEVEDAQMEIFALPNLTRKQYTAFIRKLLDDPSQSSELLSEAKKLNDSQAPK | 140 |
| Z15936 | VDAKYAKEVEAAQMEIFALPNLTRKQYTAFIRKLLDDPSQSSELLSEAKKLNDSQAPK | 141 |
| Z15937 | VDAKYAKEVVAAYQEIYQLPNLTRRQYTAFIRKLLDDPSQSSELLSEAKKLNDSQAPK | 142 |
| Z15938 | VDAKYAKETYAAQMEIFNLPNLTRKQYTAFIRKLFDDPSQSSELLSEAKKLNDSQAPK | 143 |
| Z15939 | VDAKYAKEVEQAQMEIYQLPNLTRKQYTAFIRKLFDDPSQSSELLSEAKKLNDSQAPK | 144 |

FIGURE 1F

| | | |
|---|---|---|
| Z15940 | VDAKYAKEAEVAYFEIYKLPNLTRKQYTAFIRKLLDDPSQSSELLSEAKKLNDSQAPK | 145 |
| Z15941 | VDAKYAKEAIDAYDEIYALPNLTRKQYTAFIRKLLDDPSQSSELLSEAKKLNDSQAPK | 146 |
| Z15942 | VDAKYAKEVEDAQMEIYFLPNLTRKQYTAFIRKLFDDPSQSSELLSEAKKLNDSQAPK | 147 |
| Z15943 | VDAKYAKEIENAQMEIFYLPNLTRKQYTAFIRKLFDDPSQSSELLSEAKKLNDSQAPK | 148 |
| Z15944 | VDAKYAKEVDDAYMEIFRLPNLTRRQYTAFIRKLLDDPSQSSELLSEAKKLNDSQAPK | 149 |
| Z15945 | VDAKYAKEVEEAQMEIFSLPNLTRKQYTAFIRKLLDDPSQSSELLSEAKKLNDSQAPK | 150 |
| Z15946 | VDAKYAKEVESAQMEIFKLPNLTRRQYTAFIRKLLDDPSQSSELLSEAKKLNDSQAPK | 151 |
| Z15947 | VDAKYAKETEIAQMEIFALPNLTRKQYTAFIRKLLDDPSQSSELLSEAKKLNDSQAPK | 152 |
| Z15948 | VDAKYAKEVERAQMEIFDLPNLTRKQYTAFIRKLLDDPSQSSELLSEAKKLNDSQAPK | 153 |
| Z15949 | VDAKYAKETETAQMEIFALPNLTRKQYTAFIRKLLDDPSQSSELLSEAKKLNDSQAPK | 154 |
| Z15950 | VDAKYAKEIEYAQMEIFALPNLTRKQYTAFIRKLLDDPSQSSELLSEAKKLNDSQAPK | 155 |
| Z15951 | VDAKYAKELERAQMEIYHLPNLTRKQYTAFIRKLFDDPSQSSELLSEAKKLNDSQAPK | 156 |
| Z15952 | VDAKYAKESEIAQMEIFALPNLTRKQYTAFIRKLLDDPSQSSELLSEAKKLNDSQAPK | 157 |
| Z15953 | VDAKYAKETEKAQMEIFALPNLTRKQYTAFIRKLLDDPSQSSELLSEAKKLNDSQAPK | 158 |
| Z15954 | VDAKYAKEVENAQMEIFNLPNLTRKQYTAFIRKLLDDPSQSSELLSEAKKLNDSQAPK | 159 |
| Z15955 | VDAKYAKEVEEAQLEIFALPNLTRKQYTAFIRKLLDDPSQSSELLSEAKKLNDSQAPK | 160 |
| Z15956 | VDAKYAKEVKEAQLEIFALPNLTRKQYTAFIRKLLDDPSQSSELLSEAKKLNDSQAPK | 161 |
| Z15957 | VDAKYAKEVQEAQMEIFAYMEIFHLPNLTRRQYTAFIRKLLDDPSQSSELLSEAKKLNDSQAPK | 162 |
| Z15958 | VDAKYAKEVQFAYMEIFHLPNLTRRQYTAFIRKLLDDPSQSSELLSEAKKLNDSQAPK | 163 |
| Z15959 | VDAKYAKELEHAYMEIYALPNLTRKQYTAFIRKLLDDPSQSSELLSEAKKLNDSQAPK | 164 |
| Z15960 | VDAKYAKETEAAQMEIFALPNLTRKQYTAFIRKLLDDPSQSSELLSEAKKLNDSQAPK | 165 |
| Z15961 | VDAKYAKEVETAQMEIFALPNLTRKQYTAFIRKLFDDPSQSSELLSEAKKLNDSQAPK | 166 |
| Z15962 | VDAKYAKELEKAQMEIYYLPNLTRKQYTAFIRKLLDDPSQSSELLSEAKKLNDSQAPK | 167 |
| Z15963 | VDAKYAKELEEAQMEIYDLPNLTRKQYTAFIRKLLDDPSQSSELLSEAKKLNDSQAPK | 168 |
| Z15964 | VDAKYAKELESAYMEIYSLPNLTRKQYTAFIRKLLDDPSQSSELLSEAKKLNDSQAPK | 169 |
| Z15965 | VDAKYAKEIEVAQMEIFELPNLTRKQYTAFIRKLLDDPSQSSELLSEAKKLNDSQAPK | 170 |
| Z15966 | VDAKYAKEVELAQMEIFTLPNLTRKQYTAFIRKLLDDPSQSSELLSEAKKLNDSQAPK | 171 |
| Z15967 | VDAKYAKEIEEAQMEIYYLPNLTRKQYTAFIRKLLDDPSQSSELLSEAKKLNDSQAPK | 172 |
| Z15968 | VDAKYAKEIEAAQMEIYLPNLTRKQYTAFIIKLLDDPSQSSELLSEAKKLNDSQAPK | 173 |

FIGURE 1G

| ID | Sequence | # |
|---|---|---|
| Z15969 | VDAKYAKEIEEAYMEIYNLPNLTRKQYTAFIRKLLDDPSQSSELLSEAKKLNDSQAPK | 174 |
| Z15970 | VDAKYAKEVEFAQLEIFSLPNLTRKQYTAFIRKLFDDPSQSSELLSEAKKLNDSQAPK | 175 |
| Z15971 | VDAKYAKEIEEAQMEIFALPNLTRKQYTAFIRKLLDDPSQSSELLSEAKKLNDSQAPK | 176 |
| Z15972 | VDAKYAKEVEQAQMEIFYLPNLTRKQYTAFIRKLLDDPSQSSELLSEAKKLNDSQAPK | 177 |
| Z15973 | VDAKYAKEAFTAQMEIFGLPNLTRKQYTAFIRKLLDDPSQSSELLSEAKKLNDSQAPK | 178 |
| Z15974 | VDAKYAKETHQAQMEIFALPNLTRKQYTAFIRKLLDDPSQSSELLSEAKKLNDSQAPK | 179 |
| Z15976 | VDAKYAKEVEDAQMEIFALPNLTRKQYTAFIRKLLDDPSQSSELLSEAKKLNDSQAPK | 180 |
| Z15977 | VDAKYAKEVEQAQMEIYVLPNLTRKQYTAFIRKLLDDPSQSSELLSEAKKLNDSQAPK | 181 |
| Z15978 | VDAKYAKEVEAAQMEIFNLPNLTRKQYTAFIRKLLDDPSQSSELLSEAKKLNDSQAPK | 182 |
| Z15979 | VDAKYAKEVEEAQMEIFSLPNLTRRQYTAFIRKLLDDPSQSSELLSEAKKLNDSQAPK | 183 |
| Z15980 | VDAKYAKEIEEAQMEIYALPNLTRKQYTAFIRKLLDDPSQSSELLSEAKKLNDSQAPK | 184 |
| Z15981 | VDAKYAKEIEQAQMEIFHLPNLTRKQYTAFIRKLLDDPSQSSELLSEAKKLNDSQAPK | 185 |
| Z15982 | VDAKYAKETEEAQMEIFALPNLTRKQYTAFIRKLLDDPSQSSELLSEAKKLNDSQAPK | 186 |
| Z15983 | VDAKYAKEIERAQMEIFALPNLTRKQYTAFIRKLLDDPSQSSELLSEAKKLNDSQAPK | 187 |
| Z15984 | VDAKYAKELESAQMEIYELPNLTRKQYTAFIRKLLDDPSQSSELLSEAKKLNDSQAPK | 188 |
| Z15985 | VDAKYAKEVEAAQMEIFYLPNLTRKQYTAFIRKLLDDPSQSSELLSEAKKLNDSQAPK | 189 |
| Z15986 | VDAKYAKEVEEAQMEIFGLPNLTRKQYTAFIRKLLDDPSQSSELLSEAKKLNDSQAPK | 190 |
| Z15987 | VDAKYAKEVEEAQMEIYYLPNLTRKQYTAFIRKLLDDPSQSSELLSEAKKLNDSQAPK | 191 |
| Z15988 | VDAKYAKEVEKAQMEIFGLPNLTRKQYTAFIRKLLDDPSQSSELLSEAKKLNDSQAPK | 192 |
| Z15989 | VDAKYAKEVEQAYMEIYNLPNLTRKQYTAFIRKLFDDPSQSSELLSEAKKLNDSQAPK | 193 |
| Z15990 | VDAKYAKELEHAYHEIYILPNLTRKQYTAFIRKLLDDPSQSSELLSEAKKLNDSQAPK | 194 |
| Z15991 | VDAKYAKEIEEAQMEIFNLPNLTRKQYTAFIRKLLDDPSQSSELLSEAKKLNDSQAPK | 195 |
| Z15992 | VDAKYAKEVEDAQQEIFHLPNLTRKQYTAFIRKLLDDPSQSSELLSEAKKLNDSQAPK | 196 |
| Z15993 | VDAKYAKEIEIAQMEIYALPNLTRKQYTAFIRKLLDDPSQSSELLSEAKKLNDSQAPK | 197 |
| Z15994 | VDAKYAKEVEWAQMEIFSLPNLTRKQYTAFIRKLLDDPSQSSELLSEAKKLNDSQAPK | 198 |
| Z15995 | VDAKYAKEVLDAQMEIFGLPNLTRKQYTAFIRKLLDDPSQSSELLSEAKKLNDSQAPK | 199 |
| Z15996 | VDAKYAKEVESAQMEIFNLPNLTRKQYTAFIRKLLDDPSQSSELLSEAKKLNDSQAPK | 200 |
| Z15997 | VDAKYAKEIEEAQMEIFQLPNLTRKQYTAFIRKLLDDPSQSSELLSEAKKLNDSQAPK | 201 |
| Z15998 | VDAKYAKEIEDAQMEIFYLPNLTRKQYTAFIRKLLDDPSQSSELLSEAKKLNDSQAPK | 202 |

FIGURE 1H

| | | |
|---|---|---|
| Z15999 | VDAKYAKEVEIAYMEIFHLPNLTRKQYTAFIRKLLDDPSQSSELLSEAKKLNDSQAPK | 203 |
| Z16000 | VDAKYAKEAYRAQMEIFALPNLTRKQYTAFIRKLLDDPSQSSELLSEAKKLNDSQAPK | 204 |
| Z16001 | VDAKYAKEVELAQMEIFSLPNLTRKQYTAFIRKLLDDPSQSSELLSEAKKLNDSQAPK | 205 |
| Z16002 | VDAKYAKETEHAQMEIFSLPNLTRKQYTAFIRKLFDDPSQSSELLSEAKKLNDSQAPK | 206 |
| Z16003 | VDAKYAKEVYIAQMEIYGLPNLTRKQYTAFIRKLFDDPSQSSELLSEAKKLNDSQAPK | 207 |
| Z16004 | VDAKYAKEVEVAQMEIFSLPNLTRKQYTAFIRKLLDDPSQSSELLSEAKKLNDSQAPK | 208 |
| Z16005 | VDAKYAKELEDAQMEIFKLPNLTRKQYTAFIRKLFDDPSQSSELLSEAKKLNDSQAPK | 209 |
| Z16006 | VDAKYAKEIEQAQMEIFALPNLTRKQYTAFIIKLFDDPSQSSELLSEAKKLNDSQAPK | 210 |
| Z16007 | VDAKYAKEVEIAQMEIFSLPNLTRKQYTAFIRKLFDDPSQSSELLSEAKKLNDSQAPK | 211 |
| Z16008 | VDAKYAKEVEVAQMEIFNLPNLTRRQYTAFIRKLFDDPSQSSELLSEAKKLNDSQAPK | 212 |
| Z16009 | VDAKYAKEVEEAQLEIFGLPNLTRKQYTAFIRKLLDDPSQSSELLSEAKKLNDSQAPK | 213 |
| Z16010 | VDAKYAKETEQAQMEIFNLPNLTRRQYTAFIRKLLDDPSQSSELLSEAKKLNDSQAPK | 214 |
| Z16011 | VDAKYAKEIEVAQMEIFALPNLTRKQYTAFIRKLFDDPSQSSELLSEAKKLNDSQAPK | 215 |
| Z16012 | VDAKYAKEVEQAQMEIFFLPNLTRKQYTAFIRKLLDDPSQSSELLSEAKKLNDSQAPK | 216 |
| Z16013 | VDAKYAKEIESAQMEIFDLPNLTRKQYTAFIRKLLDDPSQSSELLSEAKKLNDSQAPK | 217 |
| Z16014 | VDAKYAKEIEKAQMEIFYLPNLTRKQYTAFIRKLLDDPSQSSELLSEAKKLNDSQAPK | 218 |
| Z16015 | VDAKYAKEVEEAYMEIYYLPNLTRKQYTAFIRKLLDDPSQSSELLSEAKKLNDSQAPK | 219 |
| Z16016 | VDAKYAKEVEDAQMEIYYLPNLTRKQYTAFIRKLLDDPSQSSELLSEAKKLNDSQAPK | 220 |
| Z16017 | VDAKYAKEVEEAQMEIYDLPNLTRKQYTAFIRKLLDDPSQSSELLSEAKKLNDSQAPK | 221 |
| Z16018 | VDAKYAKEVELAQMEIFNLPNLTRKQYTAFIRKLLDDPSQSSELLSEAKKLNDSQAPK | 222 |
| Z16019 | VDAKYAKETEYAQMEIFALPNLTRKQYTAFIRKLLDDPSQSSELLSEAKKLNDSQAPK | 223 |
| Z16020 | VDAKYAKEVEAAQMEIYGLPNLTRKQYTAFIRKLFDDPSQSSELLSEAKKLNDSQAPK | 224 |
| Z16021 | VDAKYAKEVEVAQMEIFALPNLTRRQYTAFIRKLLDDPSQSSELLSEAKKLNDSQAPK | 225 |
| Z16022 | VDAKYAKEIEFAQMEIFALPNLTRKQYTAFIRKLFDDPSQSSELLSEAKKLNDSQAPK | 226 |
| Z16023 | VDAKYAKEVEEAQMEIFTLPNLTRKQYTAFIRKLLDDPSQSSELLSEAKKLNDSQAPK | 227 |
| Z16024 | VDAKYAKEVEEAQMEIFNLPNLTRKQYTAFIRKLFDDPSQSSELLSEAKKLNDSQAPK | 228 |
| Z16025 | VDAKYAKEVEVAYMEIYYLPNLTRKQYTAFIRKLLDDPSQSSELLSEAKKLNDSQAPK | 229 |
| Z16026 | VDAKYAKEVEKAQMEIYYLPNLTRKQYTAFIRKLFDDPSQSSELLSEAKKLNDSQAPK | 230 |
| Z16027 | VDAKYAKEVYQAQMEIFYLPNLTRKQYTAFIRKLLDDPSQSSELLSEAKKLNDSQAPK | 231 |

FIGURE 1I

| | | |
|---|---|---|
| Z16028 | VDAKYAKEIRDAQMEIFDLPNLTRKQYTAFIRKLFDDPSQSSELLSEAKKLNDSQAPK | 232 |
| Z16029 | VDAKYAKEIEDAQLEIFALPNLTRKQYTAFIRKLLDDPSQSSELLSEAKKLNDSQAPK | 233 |
| Z16030 | VDAKYAKEVEYAQMEIFALPNLTRKQYTAFIRKLLDDPSQSSELLSEAKKLNDSQAPK | 234 |
| Z16031 | VDAKYAKEAYYAQMEIFALPNLTRKQYTAFIRKLLDDPSQSSELLSEAKKLNDSQAPK | 235 |
| Z16032 | VDAKYAKEAEDAYMEIYELPNLTRKQYTAFIRKLLDDPSQSSELLSEAKKLNDSQAPK | 236 |
| Z16033 | VDAKYAKEIEDAYMEIYRLPNLTRRQYTAFIRKLLDDPSQSSELLSEAKKLNDSQAPK | 237 |
| Z16034 | VDAKYAKEVEEAQMEIFELPNLTRKQYTAFIRKLFDDPSQSSELLSEAKKLNDSQAPK | 238 |
| Z16035 | VDAKYAKELEEAQMEIFALPNLTRKQYTAFIRKLLDDPSQSSELLSEAKKLNDSQAPK | 239 |
| Z16036 | VDAKYAKEVETAQMEIFELPNLTRKQYTAFIRKLLDDPSQSSELLSEAKKLNDSQAPK | 240 |
| Z16037 | VDAKYAKEIEDAQMEIFQLPNLTRKQYTAFIRKLLDDPSQSSELLSEAKKLNDSQAPK | 241 |
| Z16038 | VDAKYAKEVEDAQMEIFELPNLTRKQYTAFIRKLFDDPSQSSELLSEAKKLNDSQAPK | 242 |
| Z16039 | VDAKYAKEVEEAYMEIYHLPNLTRKQYTAFIRKLLDDPSQSSELLSEAKKLNDSQAPK | 243 |
| Z16040 | VDAKYAKEVQDAQMEIFELPNLTRKQYTAFIRKLFDDPSQSSELLSEAKKLNDSQAPK | 244 |
| Z16041 | VDAKYAKEIETAQMEIFALPNLTRKQYTAFIRKLLDDPSQSSELLSEAKKLNDSQAPK | 245 |
| Z16042 | VDAKYAKEVEDAQMEIFGLPNLTRKQYTAFIRKLLDDPSQSSELLSEAKKLNDSQAPK | 246 |
| Z16043 | VDAKYAKETEEAQMEIFRLPNLTRKQYTAFIRKLLDDPSQSSELLSEAKKLNDSQAPK | 247 |
| Z16044 | VDAKYAKEVERAQMEIFNLPNLTRKQYTAFIRKLLDDPSQSSELLSEAKKLNDSQAPK | 248 |
| Z16045 | VDAKYAKEAEYAQMEIFALPNLTRRQYTAFIRKLLDDPSQSSELLSEAKKLNDSQAPK | 249 |
| Z16046 | VDAKYAKEIYSAQMEIFKLPNLTRKQYTAFIRKLFDDPSQSSELLSEAKKLNDSQAPK | 250 |
| Z16047 | VDAKYAKEIEKAQMEIFSLPNLTRKQYTAFIRKLLDDPSQSSELLSEAKKLNDSQAPK | 251 |
| Z16048 | VDAKYAKEIEEAQMEIYYLPNLTRKQYTAFIRKLLDDPSQSSELLSEAKKLNDSQAPK | 252 |
| Z16049 | VDAKYAKEVEQAQMEIFSLPNLTRKQYTAFIRKLLDDPSQSSELLSEAKKLNDSQAPK | 253 |
| Z16050 | VDAKYAKEVEAAQMEIFNLPNLTRRQYTAFIRKLLDDPSQSSELLSEAKKLNDSQAPK | 254 |
| Z16051 | VDAKYAKEVESAQMEIFALPNLTRKQYTAFIRKLLDDPSQSSELLSEAKKLNDSQAPK | 255 |
| Z16052 | VDAKYAKEIEAAQMEIFDLPNLTRKQYTAFIRKLFDDPSQSSELLSEAKKLNDSQAPK | 256 |
| Z16053 | VDAKYAKETERAQMEIFALPNLTRKQYTAFIRKLLDDPSQSSELLSEAKKLNDSQAPK | 257 |
| Z16054 | VDAKYAKEAVAYFEIYALPNLTRKQYTAFIRKLLDDPSQSSELLSEAKKLNDSQAPK | 258 |
| Z16055 | VDAKYAKEIEEAQMEIFGLPNLTRKQYTAFIRKLLDDPSQSSELLSEAKKLNDSQAPK | 259 |
| Z16056 | VDAKYAKEVEQAQMEIFGLPNLTRKQYTAFIRKLLDDPSQSSELLSEAKKLNDSQAPK | 260 |

FIGURE 1J

| | | |
|---|---|---|
| Z16057 | VDAKYAKEAEEAQMEIFTLPNLTRKQYTAFIRKLLDDPSQSSELLSEAKKLNDSQAPK | 261 |
| Z16058 | VDAKYAKEVEEAQMEIFKLPNLTRKQYTAFIRKLLDDPSQSSELLSEAKKLNDSQAPK | 262 |
| Z16059 | VDAKYAKETYYAQMEIFSLPNLTRKQYTAFIRKLLDDPSQSSELLSEAKKLNDSQAPK | 263 |
| Z16060 | VDAKYAKEVEEAQMEIYSLPNLTRKQYTAFIRKLFDDPSQSSELLSEAKKLNDSQAPK | 264 |
| Z16061 | VDAKYAKEIEAAQMEIFYLPNLTRKQYTAFIRKLLDDPSQSSELLSEAKKLNDSQAPK | 265 |
| Z16062 | VDAKYAKEIEEAQMEIFYLPNLTRKQYTAFIRKLFDDPSQSSELLSEAKKLNDSQAPK | 266 |
| Z16063 | VDAKYAKEIESAQMEIFYLPNLTRKQYTAFIRKLLDDPSQSSELLSEAKKLNDSQAPK | 267 |
| Z16065 | VDAKYAKEVEEAQMEIFALPNLTRKQYTAFIRKLLDDPSQSSELLSEAKKLNDSQAPK | 268 |
| Z16066 | VDAKYAKEAEEAYYEIFGLPNLTRRQYTAFIRKLLDDPSQSSELLSEAKKLNDSQAPK | 269 |
| Z16067 | VDAKYAKEVEIAYFEIFGLPNLTRKQYTAFIRKLFDDPSQSSELLSEAKKLNDSQAPK | 270 |
| Z16068 | VDAKYAKEVEVAQLEIFRLPNLTRKQYTAFIRKLLDDPSQSSELLSEAKKLNDSQAPK | 271 |
| Z16069 | VDAKYAKEVEEAQMEIYFLPNLTRKQYTAFIRKLLDDPSQSSELLSEAKKLNDSQAPK | 272 |
| Z16070 | VDAKYAKEIEEAQMEIYRLPNLTRKQYTAFIRKLFDDPSQSSELLSEAKKLNDSQAPK | 273 |
| Z16071 | VDAKYAKEVRAAQMEIFELPNLTRKQYTAFIRKLLDDPSQSSELLSEAKKLNDSQAPK | 274 |
| Z16072 | VDAKYAKEVEIAQMEIFELPNLTRKQYTAFIRKLLDDPSQSSELLSEAKKLNDSQAPK | 275 |
| Z16073 | VDAKYAKEAERAQMEIWKLPNLTRKQYTAFIRKLLDDPSQSSELLSEAKKLNDSQAPK | 276 |
| Z16074 | VDAKYAKETESAYWEIYALPNLTRKQYTAFIRKLLDDPSQSSELLSEAKKLNDSQAPK | 277 |
| Z16075 | VDAKYAKEVEEAQMEIFALPNLTRKQYTAFIIKLFDDPSQSSELLSEAKKLNDSQAPK | 278 |
| Z16076 | VDAKYAKELEAAQMEIYELPNLTRKQYTAFIRKLLDDPSQSSELLSEAKKLNDSQAPK | 279 |
| Z16077 | VDAKYAKEVEVAQMEIFKLPNLTRKQYTAFIRKLLDDPSQSSELLSEAKKLNDSQAPK | 280 |
| Z16078 | VDAKYAKEVEEAQMEIFELPNLTRKQYTAFIRKLFDDPSQSSELLSEAKKLNDSQAPK | 281 |
| Z16079 | VDAKYAKEVEAAYMEIYALPNLTRKQYTAFIRKLLDDPSQSSELLSEAKKLNDSQAPK | 282 |
| Z16080 | VDAKYAKEAEYAYYEIYALPNLTRKQYTAFIRKLFDDPSQSSELLSEAKKLNDSQAPK | 283 |
| Z16081 | VDAKYAKEYAYYEIYALPNLTRKQYTAFIRKLLDDPSQSSELLSEAKKLNDSQAPK | 284 |
| Z16082 | VDAKYAKEVESAQMEIFALPNLTRKQYTAFIRKLFDDPSQSSELLSEAKKLNDSQAPK | 285 |
| Z16083 | VDAKYAKELEQAQMEIFALPNLTRKQYTAFIRKLFDDPSQSSELLSEAKKLNDSQAPK | 286 |
| Z16084 | VDAKYAKEIEIAQMEIFELPNLTRKQYTAFIRKLFDDPSQSSELLSEAKKLNDSQAPK | 287 |
| Z16086 | VDAKYAKEVESAQMEIFALPNLTRKQYTAFIIKLFDDPSQSSELLSEAKKLNDSQAPK | 288 |
| Z16087 | VDAKYAKEAENAQMEIFNLPNLTRKQYTAFIRKLLDDPSQSSELLSEAKKLNDSQAPK | 289 |

FIGURE 1K

| | | |
|---|---|---|
| Z16088 | VDAKYAKEVTTAYYEIYNLPNLTRRQYTAFIRKLLDDPSQSSELLSEAKKLNDSQAPK | 290 |
| Z16089 | VDAKYAKEIESAYYEIFALPNLTRKQYTAFIRKLLDDPSQSSELLSEAKKLNDSQAPK | 291 |
| Z16090 | VDAKYAKEVEEAQMEIFYLPNLTRRQYTAFIKLLDDPSQSSELLSEAKKLNDSQAPK | 292 |
| Z16092 | VDAKYAKEIEQAQMEIYRLPNLTRKQYTAFIRKLLDDPSQSSELLSEAKKLNDSQAPK | 293 |
| Z16093 | VDAKYAKETEEAQMEIFALPNLTRKQYTAFIRKLFDDPSQSSELLSEAKKLNDSQAPK | 294 |
| Z16094 | VDAKYAKEVEEAQMEIFYLPNLTRRQYTAFIRKLFDDPSQSSELLSEAKKLNDSQAPK | 295 |
| Z16095 | VDAKYAKEAAAAHWEIYNLPNLTRKQYTAFIRKLFDDPSQSSELLSEAKKLNDSQAPK | 296 |
| Z16096 | VDAKYAKEVERAQMEIFGLPNLTRRQYTAFIIKLLDDPSQSSELLSEAKKLNDSQAPK | 297 |
| Z16097 | VDAKYAKETERAQMEIFSLPNLTRKQYTAFIRKLLDDPSQSSELLSEAKKLNDSQAPK | 298 |
| Z16098 | VDAKYAKEVEEAQMEIYVLPNLTRKQYTAFIRKLLDDPSQSSELLSEAKKLNDSQAPK | 299 |
| Z16099 | VDAKYAKEAENAYHEIFNLPNLTRKQYTAFIRKLLDDPSQSSELLSEAKKLNDSQAPK | 300 |
| Z16101 | VDAKYAKEAYAAQMEIYALPNLTRKQYTAFIRKLLDDPSQSSELLSEAKKLNDSQAPK | 301 |
| Z16102 | VDAKYAKEVETAQMEIYQLPNLTRKQYTAFIRKLFDDPSQSSELLSEAKKLNDSQAPK | 302 |
| Z16103 | VDAKYAKEAEDAQLEIFKLPNLTRKQYTAFIRKLLDDPSQSSELLSEAKKLNDSQAPK | 303 |
| Z16104 | VDAKYAKEAQEAYYEIFALPNLTRKQYTAFIRKLLDDPSQSSELLSEAKKLNDSQAPK | 304 |
| Z16105 | VDAKYAKEVEHAYMEIYSLPNLTRKQYTAFIRKLLDDPSQSSELLSEAKKLNDSQAPK | 305 |
| Z16106 | VDAKYAKEVEDAQMEIFKLPNLTRKQYTAFIRKLFDDPSQSSELLSEAKKLNDSQAPK | 306 |
| Z16107 | VDAKYAKEVEEAYMEIYRLPNLTRKQYTAFIRKLLDDPSQSSELLSEAKKLNDSQAPK | 307 |
| Z16108 | VDAKYAKEIEYAQMEIFDLPNLTRKQYTAFIRKLFDDPSQSSELLSEAKKLNDSQAPK | 308 |
| Z16109 | VDAKYAKEAEWAYMEIFALPNLTRKQYTAFIRKLLDDPSQSSELLSEAKKLNDSQAPK | 309 |
| Z16110 | VDAKYAKEVEEAQYEIFNLPNLTRKQYTAFIRKLLDDPSQSSELLSEAKKLNDSQAPK | 310 |
| Z16111 | VDAKYAKEIEAAQMEIFSLPNLTRKQYTAFIRKLFDDPSQSSELLSEAKKLNDSQAPK | 311 |
| Z16112 | VDAKYAKEVENAYMEIFRLPNLTRKQYTAFIRKLLDDPSQSSELLSEAKKLNDSQAPK | 312 |
| Z16113 | VDAKYAKEVEHAYQEIFNLPNLTRKQYTAFIRKLLDDPSQSSELLSEAKKLNDSQAPK | 313 |
| Z16114 | VDAKYAKEVEDAYMEIYYLPNLTRKQYTAFIRKLLDDPSQSSELLSEAKKLNDSQAPK | 314 |
| Z16115 | VDAKYAKEVEDAQMEIFGLPNLTRKQYTAFIIKLLDDPSQSSELLSEAKKLNDSQAPK | 315 |
| Z16116 | VDAKYAKEVEEAQMEIFGLPNLTRKQYTAFIRKLFDDPSQSSELLSEAKKLNDSQAPK | 316 |
| Z16117 | VDAKYAKEIEKAQFEIFALPNLTRKQYTAFIRKLFDDPSQSSELLSEAKKLNDSQAPK | 317 |
| Z16118 | VDAKYAKEVEDAQMEIYSLPNLTRKQYTAFIRKLFDDPSQSSELLSEAKKLNDSQAPK | 318 |

FIGURE 1L

| | | |
|---|---|---|
| Z16119 | VDAKYAKEAESAYLETYHLPNLTRKQYTAFIRKLLDDPSQSSELLSEAKKLNDSQAPK | 319 |
| Z16120 | VDAKYAKEVVEAYFEIYRLPNLTRKQYTAFIRKLLDDPSQSSELLSEAKKLNDSQAPK | 320 |
| Z16121 | VDAKYAKEVEDAYFEIYNLPNLTRKQYTAFIRKLLDDPSQSSELLSEAKKLNDSQAPK | 321 |
| Z16122 | VDAKYAKEAEDAYMEIYSLPNLTRRQYTAFIRKLLDDPSQSSELLSEAKKLNDSQAPK | 322 |
| Z16125 | VDAKYAKEAQDAYMEIYGLPNLTRKQYTAFIRKLLDDPSQSSELLSEAKKLNDSQAPK | 323 |
| Z16126 | VDAKYAKEIEAAQMEIYSLPNLTRKQYTAFIRKLLDDPSQSSELLSEAKKLNDSQAPK | 324 |
| Z16127 | VDAKYAKEIEIAQMEIFGLPNLTRKQYTAFIRKLLDDPSQSSELLSEAKKLNDSQAPK | 325 |
| Z16128 | VDAKYAKEVEHAQMEIFSLPNLTRKQYTAFIRKLLDDPSQSSELLSEAKKLNDSQAPK | 326 |
| Z16129 | VDAKYAKEAEEAQYEIFKLPNLTRKQYTAFIRKLLDDPSQSSELLSEAKKLNDSQAPK | 327 |
| Z16130 | VDAKYAKEVYHAQMEIFKLPNLTRKQYTAFIRKLFDDPSQSSELLSEAKKLNDSQAPK | 328 |
| Z16131 | VDAKYAKEVEIAQLEIFALPNLTRKQYTAFIRKLLDDPSQSSELLSEAKKLNDSQAPK | 329 |
| Z16132 | VDAKYAKELERAYAEIYALPNLTRKQYTAFIRKLLDDPSQSSELLSEAKKLNDSQAPK | 330 |
| Z16133 | VDAKYAKEVDEAYMEIFNLPNLTRKQYTAFIRKLLDDPSQSSELLSEAKKLNDSQAPK | 331 |
| Z16134 | VDAKYAKEFHRAYSEIYLLPNLTRKQYTAFIRKLFDDPSQSSELLSEAKKLNDSQAPK | 332 |
| Z16135 | VDAKYAKEVELAQHEIFQLPNLTRKQYTAFIRKLLDDPSQSSELLSEAKKLNDSQAPK | 333 |
| Z16136 | VDAKYAKEVESAQMEIFELPNLTRKQYTAFIRKLLDDPSQSSELLSEAKKLNDSQAPK | 334 |
| Z16137 | VDAKYAKEAEIAYYEIYSLPNLTRRQYTAFIRKLLDDPSQSSELLSEAKKLNDSQAPK | 335 |
| Z16138 | VDAKYAKEVEDAYFEIYGLPNLTRKQYTAFIRKLLDDPSQSSELLSEAKKLNDSQAPK | 336 |
| Z16139 | VDAKYAKETFKAQQEIFALPNLTRRQYTAFIRKLLDDPSQSSELLSEAKKLNDSQAPK | 337 |
| Z16140 | VDAKYAKEAEQAYWEIFSLPNLTRKQYTAFIRKLLDDPSQSSELLSEAKKLNDSQAPK | 338 |
| Z16141 | VDAKYAKEVVQAYDETYGLPNLTRKQYTAFIRKLLDDPSQSSELLSEAKKLNDSQAPK | 339 |
| Z16142 | VDAKYAKEASDAYEEIYALPNLTRKQYTAFIRKLLDDPSQSSELLSEAKKLNDSQAPK | 340 |
| Z16143 | VDAKYAKEIEAAQMEIFRLPNLTRKQYTAFIRKLLDDPSQSSELLSEAKKLNDSQAPK | 341 |
| Z16144 | VDAKYAKEAEEAYFEIFALPNLTRKQYTAFIRKLLDDPSQSSELLSEAKKLNDSQAPK | 342 |
| Z16145 | VDAKYAKEVEHAQYEIFQLPNLTRKQYTAFIRKLLDDPSQSSELLSEAKKLNDSQAPK | 343 |
| Z16146 | VDAKYAKEAEKAQMEIFALPNLTRKQYTAFIRKLLDDPSQSSELLSEAKKLNDSQAPK | 344 |
| Z16147 | VDAKYAKEVDAAYMEIYNLPNLTRKQYTAFIIKLLDDPSQSSELLSEAKKLNDSQAPK | 345 |
| Z16148 | VDAKYAKEVEIAQMEIAQMEIYNLPNLTRKQYTAFIRKLLDDPSQSSELLSEAKKLNDSQAPK | 346 |
| Z16149 | VDAKYAKEVENAYFEIYQLPNLTRKQYTAFIRKLLDDPSQSSELLSEAKKLNDSQAPK | 347 |

FIGURE 1M

| | | |
|---|---|---|
| Z16150 | VDAKYAKEVEDAYFEIYELPNLTRKQYTAFIRKLLDDPSQSSELLSEAKKLNDSQAPK | 348 |
| Z16152 | VDAKYAKEVEKAYFEIYQLPNLTRKQYTAFIRKLLDDPSQSSELLSEAKKLNDSQAPK | 349 |
| Z16154 | VDAKYAKEIEAAQMEIFALPNLTRKQYTAFIRKLLDDPSQSSELLSEAKKLNDSQAPK | 350 |
| Z16155 | VDAKYAKETWYAQMEIFSLPNLTRKQYTAFIRKLLDDPSQSSELLSEAKKLNDSQAPK | 351 |
| Z16156 | VDAKYAKEIERAQMEIFSLPNLTRKQYTAFIRKLLDDPSQSSELLSEAKKLNDSQAPK | 352 |
| Z16157 | VDAKYAKEVDDAYMEIYLPNLTRKQYTAFIRKLLDDPSQSSELLSEAKKLNDSQAPK | 353 |
| Z16158 | VDAKYAKEVEAAYVEIYHLPNLTRKQYTAFIRKLLDDPSQSSELLSEAKKLNDSQAPK | 354 |
| Z16159 | VDAKYAKEFSEAYFEIYSLPNLTRKQYTAFIRKLFDDPSQSSELLSEAKKLNDSQAPK | 355 |
| Z16160 | VDAKYAKEVAKAQMEIFKLPNLTRKQYTAFIRKLLDDPSQSSELLSEAKKLNDSQAPK | 356 |
| Z16161 | VDAKYAKEVEYAQMEIYSLPNLTRRQYTAFIRKLLDDPSQSSELLSEAKKLNDSQAPK | 357 |
| Z16162 | VDAKYAKEAESAYWEIYHLPNLTRKQYTAFIRKLLDDPSQSSELLSEAKKLNDSQAPK | 358 |
| Z16163 | VDAKYAKEVERAQMEIFELPNLTRRQYTAFIRKLLDDPSQSSELLSEAKKLNDSQAPK | 359 |
| Z16164 | VDAKYAKEVEEAYMEIYNLPNLTRKQYTAFIRKLLDDPSQSSELLSEAKKLNDSQAPK | 360 |
| Z16165 | VDAKYAKEIEVAQMEIYSLPNLTRKQYTAFIRKLFDDPSQSSELLSEAKKLNDSQAPK | 361 |
| Z16166 | VDAKYAKEVRIAQFEIFALPNLTRKQYTAFIRKLLDDPSQSSELLSEAKKLNDSQAPK | 362 |
| Z16167 | VDAKYAKEVEQAQHEIFNLPNLTRKQYTAFIRKLLDDPSQSSELLSEAKKLNDSQAPK | 363 |
| Z16168 | VDAKYAKEAVSAYWEIFALPNLTRKQYTAFIRKLLDDPSQSSELLSEAKKLNDSQAPK | 364 |
| Z16169 | VDAKYAKETEEAQMEIFYLPNLTRRQYTAFIRKLLDDPSQSSELLSEAKKLNDSQAPK | 365 |
| Z16170 | VDAKYAKEADAAYMEIFGLPNLTRKQYTAFIRKLLDDPSQSSELLSEAKKLNDSQAPK | 366 |
| Z16171 | VDAKYAKETAAAQAEIFNLPNLTRKQYTAFIRKLLDDPSQSSELLSEAKKLNDSQAPK | 367 |
| Z16172 | VDAKYAKEAFDAYWEIYRLPNLTRKQYTAFIRKLLDDPSQSSELLSEAKKLNDSQAPK | 368 |
| Z16173 | VDAKYAKEIEAAYAEIYQLPNLTRKQYTAFIRKLLDDPSQSSELLSEAKKLNDSQAPK | 369 |
| Z16174 | VDAKYAKEVIDAYFEIFHLPNLTRKQYTAFIRKLLDDPSQSSELLSEAKKLNDSQAPK | 370 |
| Z16175 | VDAKYAKEVESAQMEIYRLPNLTRKQYTAFIRKLLDDPSQSSELLSEAKKLNDSQAPK | 371 |
| Z16176 | VDAKYAKETEEAYQEIFDLPNLTRKQYTAFIRKLLDDPSQSSELLSEAKKLNDSQAPK | 372 |
| Z16177 | VDAKYAKEVEIAQMEIYSLPNLTRKQYTAFIRKLLDDPSQSSELLSEAKKLNDSQAPK | 373 |
| Z16178 | VDAKYAKEVEEAQMEIFFLPNLTRKQYTAFIIKLFDDPSQSSELLSEAKKLNDSQAPK | 374 |
| Z16179 | VDAKYAKEIEIAQMEIYYLPNLTRKQYTAFIRKLLDDPSQSSELLSEAKKLNDSQAPK | 375 |
| Z16180 | VDAKYAKETYWAQQEIFYLPNLTRKQYTAFIRKLLDDPSQSSELLSEAKKLNDSQAPK | 376 |

FIGURE 1N

| | | |
|---|---|---|
| Z16181 | VDAKYAKEAESAQMEIYALPNLTRKQYTAFIRKLLDDPSQSSELLSEAKKLNDSQAPK | 377 |
| Z16182 | VDAKYAKELETAYFEIYELPNLTRKQYTAFIRKLLDDPSQSSELLSEAKKLNDSQAPK | 378 |
| Z16183 | VDAKYAKEVEDAQMEIFYLPNLTRKQYTAFIRKLLDDPSQSSELLSEAKKLNDSQAPK | 379 |
| Z16184 | VDAKYAKELELAYQEIYALPNLTRRQYTAFIRKLLDDPSQSSELLSEAKKLNDSQAPK | 380 |
| Z16185 | VDAKYAKEIVAAYWEIYYLPNLTRKQYTAFIRKLLDDPSQSSELLSEAKKLNDSQAPK | 381 |
| Z16186 | VDAKYAKEVEEAYMEIYALPNLTRKQYTAFIRKLLDDPSQSSELLSEAKKLNDSQAPK | 382 |
| Z16187 | VDAKYAKEIDSAYFEIYALPNLTRKQYTAFIRKLLDDPSQSSELLSEAKKLNDSQAPK | 383 |
| Z16188 | VDAKYAKEAEQAYQEIYELPNLTRKQYTAFIRKLLDDPSQSSELLSEAKKLNDSQAPK | 384 |
| Z16189 | VDAKYAKEAYRAQMEIFELPNLTRKQYTAFIRKLLDDPSQSSELLSEAKKLNDSQAPK | 385 |
| Z16190 | VDAKYAKEVEDAYFEIYALPNLTRKQYTAFIRKLLDDPSQSSELLSEAKKLNDSQAPK | 386 |
| Z16191 | VDAKYAKEIEAAQMEIFYLPNLTRKQYTAFIRKLFDDPSQSSELLSEAKKLNDSQAPK | 387 |
| Z16192 | VDAKYAKEAYEAQMEIFELPNLTRKQYTAFIRKLLDDPSQSSELLSEAKKLNDSQAPK | 388 |
| Z16193 | VDAKYAKEVVDAYFEIYELPNLTRKQYTAFIRKLLDDPSQSSELLSEAKKLNDSQAPK | 389 |
| Z16194 | VDAKYAKEVEQAQMEIFKLPNLTRKQYTAFIRKLLDDPSQSSELLSEAKKLNDSQAPK | 390 |
| Z16195 | VDAKYAKETEKAQMEIFELPNLTRKQYTAFIIKLLDDPSQSSELLSEAKKLNDSQAPK | 391 |
| Z16196 | VDAKYAKETYQAQMEIFGLPNLTRRQYTAFIRKLLDDPSQSSELLSEAKKLNDSQAPK | 392 |
| Z16197 | VDAKYAKEVESAQMEIFALPNLTRKQYTAFIRKLLDDPSQSSELLSEAKKLNDSQAPK | 393 |
| Z16198 | VDAKYAKEIEDAQMEIFGLPNLTRRQYTAFIRKLFDDPSQSSELLSEAKKLNDSQAPK | 394 |
| Z16199 | VDAKYAKEVEKAQLEIFALPNLTRKQYTAFIRKLFDDPSQSSELLSEAKKLNDSQAPK | 395 |
| Z16200 | VDAKYAKEIEQAQFEIFYLPNLTRKQYTAFIRKLLDDPSQSSELLSEAKKLNDSQAPK | 396 |
| Z16201 | VDAKYAKETEVAQMEIFKLPNLTRKQYTAFIRKLLDDPSQSSELLSEAKKLNDSQAPK | 397 |
| Z16202 | VDAKYAKEVEQAQMEIFELPNLTRKQYTAFIRKLLDDPSQSSELLSEAKKLNDSQAPK | 398 |
| Z16203 | VDAKYAKEVEIAQHEIFELPNLTRKQYTAFIRKLLDDPSQSSELLSEAKKLNDSQAPK | 399 |
| Z16204 | VDAKYAKEVELAYMEIYKLPNLTRKQYTAFIRKLLDDPSQSSELLSEAKKLNDSQAPK | 400 |
| Z16205 | VDAKYAKEVVQAYDEIFQLPNLTRKQYTAFIRKLLDDPSQSSELLSEAKKLNDSQAPK | 401 |
| Z16206 | VDAKYAKEVEEAQMEIFNLPNLTRKQYTAFIRKLFDDPSQSSELLSEAKKLNDSQAPK | 402 |
| Z16207 | VDAKYAKEVEEAQMEIYNLPNLTRKQYTAFIRKLFDDPSQSSELLSEAKKLNDSQAPK | 403 |
| Z16208 | VDAKYAKEVEKAQMEIFDLPNLTRKQYTAFIRKLFDDPSQSSELLSEAKKLNDSQAPK | 404 |
| Z16209 | VDAKYAKEVEEAYWEIYALPNLTRKQYTAFIRKLLDDPSQSSELLSEAKKLNDSQAPK | 405 |

FIGURE 10

| | | |
|---|---|---|
| Z16210 | VDAKYAKEAETAYHEIYILPNLTRKQYTAFIRKLLDDPSQSSELLSEAKKLNDSQAPK | 406 |
| Z16211 | VDAKYAKEAEEAQMEIYNLPNLTRKQYTAFIRKLLDDPSQSSELLSEAKKLNDSQAPK | 407 |
| Z16212 | VDAKYAKEVEFAYFEIYALPNLTRKQYTAFIRKLLDDPSQSSELLSEAKKLNDSQAPK | 408 |
| Z16213 | VDAKYAKEARQAYWEIYSLPNLTRKQYTAFIRKLLDDPSQSSELLSEAKKLNDSQAPK | 409 |
| Z16214 | VDAKYAKETETAQLEIFALPNLTRKQYTAFIRKLLDDPSQSSELLSEAKKLNDSQAPK | 410 |
| Z16215 | VDAKYAKEIEEAQHEIFRLPNLTRKQYTAFIRKLFDDPSQSSELLSEAKKLNDSQAPK | 411 |
| Z16216 | VDAKYAKEVSNAYMEIYKLPNLTRKQYTAFIRKLLDDPSQSSELLSEAKKLNDSQAPK | 412 |
| Z16217 | VDAKYAKEIEEAQMEIYELPNLTRKQYTAFIRKLLDDPSQSSELLSEAKKLNDSQAPK | 413 |
| Z16218 | VDAKYAKEVTDAQMEIFALPNLTRKQYTAFIRKLLDDPSQSSELLSEAKKLNDSQAPK | 414 |
| Z16219 | VDAKYAKEIEHAQLEIFSLPNLTRKQYTAFIRKLLDDPSQSSELLSEAKKLNDSQAPK | 415 |
| Z16220 | VDAKYAKEVQAQMEIFNLPNLTRKQYTAFIRKLLDDPSQSSELLSEAKKLNDSQAPK | 416 |
| Z16221 | VDAKYAKEAEAWAQMEIFSLPNLTRKQYTAFIRKLLDDPSQSSELLSEAKKLNDSQAPK | 417 |
| Z16222 | VDAKYAKEVHAAQMEIFELPNLTRKQYTAFIRKLLDDPSQSSELLSEAKKLNDSQAPK | 418 |
| Z16223 | VDAKYAKEVEFAQMEIYYLPNLTRKQYTAFIRKLLDDPSQSSELLSEAKKLNDSQAPK | 419 |
| Z16224 | VDAKYAKEVIDAYFEIYELPNLTRKQYTAFIRKLLDDPSQSSELLSEAKKLNDSQAPK | 420 |
| Z16225 | VDAKYAKEVEDAYMEIYDLPNLTRKQYTAFIRKLLDDPSQSSELLSEAKKLNDSQAPK | 421 |
| Z16227 | VDAKYAKEVEAAQLEIFALPNLTRKQYTAFIRKLLDDPSQSSELLSEAKKLNDSQAPK | 422 |
| Z16228 | VDAKYAKETVAAYWEIYALPNLTRKQYTAFIRKLLDDPSQSSELLSEAKKLNDSQAPK | 423 |
| Z16229 | VDAKYAKEVVDAYWEIYALPNLTRKQYTAFIRKLLDDPSQSSELLSEAKKLNDSQAPK | 424 |
| Z16230 | VDAKYAKETEEAYWEIYGLPNLTRKQYTAFIRKLLDDPSQSSELLSEAKKLNDSQAPK | 425 |
| Z16231 | VDAKYAKEVETAYFEIYHLPNLTRKQYTAFIRKLLDDPSQSSELLSEAKKLNDSQAPK | 426 |
| Z16232 | VDAKYAKEVVDAYYEIYELPNLTRKQYTAFIRKLLDDPSQSSELLSEAKKLNDSQAPK | 427 |
| Z16233 | VDAKYAKEVQEAYMEIFQLPNLTRKQYTAFIRKLLDDPSQSSELLSEAKKLNDSQAPK | 428 |
| Z16234 | VDAKYAKEVEDAYYEIYSLPNLTRKQYTAFIRKLLDDPSQSSELLSEAKKLNDSQAPK | 429 |
| Z16235 | VDAKYAKEVVEAYDEIFRLPNLTRKQYTAFIRKLLDDPSQSSELLSEAKKLNDSQAPK | 430 |
| Z16236 | VDAKYAKETEEAQMEIFNLPNLTRKQYTAFIRKLLDDPSQSSELLSEAKKLNDSQAPK | 431 |
| Z16237 | VDAKYAKEVIDAYDEIYDLPNLTRKQYTAFIRKLLDDPSQSSELLSEAKKLNDSQAPK | 432 |
| Z16238 | VDAKYAKEVVDAYYEIYALPNLTRKQYTAFIRKLLDDPSQSSELLSEAKKLNDSQAPK | 433 |
| Z16239 | VDAKYAKEVEEAYFEIYHLPNLTRKQYTAFIRKLLDDPSQSSELLSEAKKLNDSQAPK | 434 |

FIGURE 1P

| | | |
|---|---|---|
| Z16240 | VDAKYAKEVESAYMEIFALPNLTRKQYTAFIRKLLDDPSQSSELLSEAKKLNDSQAPK | 435 |
| Z16241 | VDAKYAKEVEDAYWEIYALPNLTRKQYTAFIRKLLDDPSQSSELLSEAKKLNDSQAPK | 436 |
| Z16242 | VDAKYAKEAESAYFEIYALPNLTRKQYTAFIRKLLDDPSQSSELLSEAKKLNDSQAPK | 437 |
| Z16243 | VDAKYAKEVEEAYMEIYQLPNLTRKQYTAFIRKLLDDPSQSSELLSEAKKLNDSQAPK | 438 |
| Z16244 | VDAKYAKEVEHAYFEIYKLPNLTRKQYTAFIRKLLDDPSQSSELLSEAKKLNDSQAPK | 439 |
| Z16245 | VDAKYAKEVETAYFEIFALPNLTRKQYTAFIRKLLDDPSQSSELLSEAKKLNDSQAPK | 440 |
| Z16246 | VDAKYAKEVEDAYMEIFKLPNLTRKQYTAFIRKLLDDPSQSSELLSEAKKLNDSQAPK | 441 |
| Z16247 | VDAKYAKEAHDAYWEIYSLPNLTRKQYTAFIRKLLDDPSQSSELLSEAKKLNDSQAPK | 442 |
| Z16248 | VDAKYAKEVEDAYMEIYRLPNLTRKQYTAFIRKLLDDPSQSSELLSEAKKLNDSQAPK | 443 |
| Z16249 | VDAKYAKEVEEAYEEIYQLPNLTRKQYTAFIRKLLDDPSQSSELLSEAKKLNDSQAPK | 444 |
| Z16250 | VDAKYAKEVEIAYMEIYQLPNLTRKQYTAFIRKLLDDPSQSSELLSEAKKLNDSQAPK | 445 |
| Z16251 | VDAKYAKEVEQAYFEIYGLPNLTRKQYTAFIRKLLDDPSQSSELLSEAKKLNDSQAPK | 446 |
| Z16252 | VDAKYAKEVEEAYMEIYELPNLTRKQYTAFIRKLLDDPSQSSELLSEAKKLNDSQAPK | 447 |
| Z16253 | VDAKYAKEVEEAYYEIYLLPNLTRKQYTAFIRKLLDDPSQSSELLSEAKKLNDSQAPK | 448 |
| Z16255 | VDAKYAKETEDAYMEIYALPNLTRKQYTAFIRKLLDDPSQSSELLSEAKKLNDSQAPK | 449 |
| Z16256 | VDAKYAKEVEHAYFEIFGLPNLTRKQYTAFIRKLLDDPSQSSELLSEAKKLNDSQAPK | 450 |
| Z16257 | VDAKYAKEVEEAYFEIYELPNLTRKQYTAFIRKLLDDPSQSSELLSEAKKLNDSQAPK | 451 |
| Z16258 | VDAKYAKEVETAYMEIFYLPNLTRKQYTAFIRKLLDDPSQSSELLSEAKKLNDSQAPK | 452 |
| Z16259 | VDAKYAKEVEDAYMEIYHLPNLTRKQYTAFIRKLLDDPSQSSELLSEAKKLNDSQAPK | 453 |
| Z16260 | VDAKYAKEIEEAYMEIYQLPNLTRKQYTAFIRKLLDDPSQSSELLSEAKKLNDSQAPK | 454 |
| Z16261 | VDAKYAKEVEDAYFEIYTLPNLTRKQYTAFIRKLLDDPSQSSELLSEAKKLNDSQAPK | 455 |
| Z16262 | VDAKYAKEVEEAYFEIFKLPNLTRKQYTAFIRKLLDDPSQSSELLSEAKKLNDSQAPK | 456 |
| Z16263 | VDAKYAKEAEKAYWEIYALPNLTRKQYTAFIRKLLDDPSQSSELLSEAKKLNDSQAPK | 457 |
| Z16264 | VDAKYAKEVEVAYFEIFALPNLTRKQYTAFIRKLLDDPSQSSELLSEAKKLNDSQAPK | 458 |
| Z16265 | VDAKYAKEVEEAYFEIFELPNLTRKQYTAFIRKLLDDPSQSSELLSEAKKLNDSQAPK | 459 |
| Z16266 | VDAKYAKEVTDAYMEIFHLPNLTRKQYTAFIRKLLDDPSQSSELLSEAKKLNDSQAPK | 460 |
| Z16268 | VDAKYAKEVEVAYWEIFELPNLTRKQYTAFIRKLLDDPSQSSELLSEAKKLNDSQAPK | 461 |
| Z16269 | VDAKYAKEVEYAYFEIYELPNLTRKQYTAFIRKLLDDPSQSSELLSEAKKLNDSQAPK | 462 |
| Z16270 | VDAKYAKEVEAAYMEIFYLPNLTRKQYTAFIRKLLDDPSQSSELLSEAKKLNDSQAPK | 463 |

FIGURE 1Q

| | | |
|---|---|---|
| Z16271 | VDAKYAKEVEDAYWEIFHLPNLTRKQYTAFIRKLLDDPSQSSELLSEAKKLNDSQAPK | 464 |
| Z16272 | VDAKYAKEVVDAYYEIFELPNLTRKQYTAFIRKLLDDPSQSSELLSEAKKLNDSQAPK | 465 |
| Z16273 | VDAKYAKEATAAYMEIYFLPNLTRKQYTAFIRKLLDDPSQSSELLSEAKKLNDSQAPK | 466 |
| Z16274 | VDAKYAKEASDAYQEIYALPNLTRKQYTAFIRKLLDDPSQSSELLSEAKKLNDSQAPK | 467 |
| Z16275 | VDAKYAKEAQTAYWEIYKLPNLTRKQYTAFIRKLLDDPSQSSELLSEAKKLNDSQAPK | 468 |
| Z16276 | VDAKYAKETVDAYWEIYALPNLTRKQYTAFIRKLLDDPSQSSELLSEAKKLNDSQAPK | 469 |
| Z16277 | VDAKYAKEVEDAYYEIYELPNLTRKQYTAFIRKLLDDPSQSSELLSEAKKLNDSQAPK | 470 |
| Z16278 | VDAKYAKEVVEAYWEIYSLPNLTRKQYTAFIRKLLDDPSQSSELLSEAKKLNDSQAPK | 471 |
| Z16279 | VDAKYAKEADEAYWEIYSLPNLTRKQYTAFIRKLLDDPSQSSELLSEAKKLNDSQAPK | 472 |
| Z16280 | VDAKYAKEVEFAYFEIYNLPNLTRKQYTAFIRKLLDDPSQSSELLSEAKKLNDSQAPK | 473 |
| Z16281 | VDAKYAKEVVDAYYEIYNLPNLTRKQYTAFIRKLLDDPSQSSELLSEAKKLNDSQAPK | 474 |
| Z16282 | VDAKYAKEVEAAYFEIFSLPNLTRKQYTAFIRKLLDDPSQSSELLSEAKKLNDSQAPK | 475 |
| Z16283 | VDAKYAKEVEDAYMEIFQLPNLTRKQYTAFIRKLLDDPSQSSELLSEAKKLNDSQAPK | 476 |
| Z16284 | VDAKYAKEAELAYWEIYKLPNLTRKQYTAFIRKLLDDPSQSSELLSEAKKLNDSQAPK | 477 |
| Z16285 | VDAKYAKEVEKAYMEIYYLPNLTRKQYTAFIRKLLDDPSQSSELLSEAKKLNDSQAPK | 478 |
| Z16286 | VDAKYAKEQEFAYFEIYKLPNLTRKQYTAFIRKLLDDPSQSSELLSEAKKLNDSQAPK | 479 |
| Z16287 | VDAKYAKELDAAYMEIYGLPNLTRRQYTAFIRKLLDDPSQSSELLSEAKKLNDSQAPK | 480 |
| Z16288 | VDAKYAKEAEQAYYEIYELPNLTRKQYTAFIRKLLDDPSQSSELLSEAKKLNDSQAPK | 481 |
| Z16289 | VDAKYAKEHVEAYFEIFSLPNLTRKQYTAFIRKLLDDPSQSSELLSEAKKLNDSQAPK | 482 |
| Z16290 | VDAKYAKEVTAAYYEIFALPNLTRKQYTAFIRKLLDDPSQSSELLSEAKKLNDSQAPK | 483 |
| Z16291 | VDAKYAKEVETAYFEIYNLPNLTRKQYTAFIRKLLDDPSQSSELLSEAKKLNDSQAPK | 484 |
| Z16292 | VDAKYAKEAQDAYFEIYELPNLTRKQYTAFIRKLLDDPSQSSELLSEAKKLNDSQAPK | 485 |
| Z16293 | VDAKYAKEVITAYWEIFALPNLTRKQYTAFIRKLLDDPSQSSELLSEAKKLNDSQAPK | 486 |
| Z16294 | VDAKYAKEVENAQMEIFALPNLTRKQYTAFIRKLLDDPSQSSELLSEAKKLNDSQAPK | 487 |
| Z16295 | VDAKYAKEHVDAYWEIYALPNLTRKQYTAFIRKLLDDPSQSSELLSEAKKLNDSQAPK | 488 |
| Z16296 | VDAKYAKEVTNAYFEIYDLPNLTRKQYTAFIRKLLDDPSQSSELLSEAKKLNDSQAPK | 489 |
| Z16297 | VDAKYAKEAEAQMEIFNLPNLTRKQYTAFIRKLLDDPSQSSELLSEAKKLNDSQAPK | 490 |
| Z16298 | VDAKYAKEVHEAYFEIYDLPNLTRKQYTAFIRKLLDDPSQSSELLSEAKKLNDSQAPK | 491 |
| Z16299 | VDAKYAKEADIAYWEIYALPNLTRKQYTAFIRKLLDDPSQSSELLSEAKKLNDSQAPK | 492 |

FIGURE 1R

| | | |
|---|---|---|
| Z16300 | VDAKYAKEVEVAYMEIYRLPNLTRKQYTAFIRKLLDDPSQSSELLSEAKKLNDSQAPK | 493 |
| Z16301 | VDAKYAKEIEAAQMEIFELPNLTRKQYTAFIRKLLDDPSQSSELLSEAKKLNDSQAPK | 494 |
| Z16302 | VDAKYAKEVETAYFEIYNLPNLTRKQYTAFIRKLLDDPSQSSELLSEAKKLNDSQAPK | 495 |
| Z16303 | VDAKYAKEAQQAYWEIFALPNLTRKQYTAFIRKLLDDPSQSSELLSEAKKLNDSQAPK | 496 |
| Z16304 | VDAKYAKEIDKAYFEIFELPNLTRKQYTAFIRKLLDDPSQSSELLSEAKKLNDSQAPK | 497 |
| Z16305 | VDAKYAKEVESAYFEIYSLPNLTRKQYTAFIRKLLDDPSQSSELLSEAKKLNDSQAPK | 498 |
| Z16306 | VDAKYAKELYLAYFEIYALPNLTRKQYTAFIRKLLDDPSQSSELLSEAKKLNDSQAPK | 499 |
| Z16307 | VDAKYAKEAVEAYFEIYELPNLTRKQYTAFIRKLLDDPSQSSELLSEAKKLNDSQAPK | 500 |
| Z16308 | VDAKYAKEAVNAYWEIFALPNLTRRQYTAFIRKLLDDPSQSSELLSEAKKLNDSQAPK | 501 |
| Z16309 | VDAKYAKELEYAYFEIYKLPNLTRKQYTAFIRKLLDDPSQSSELLSEAKKLNDSQAPK | 502 |
| Z16311 | VDAKYAKEVQAAYWEIFALPNLTRKQYTAFIRKLLDDPSQSSELLSEAKKLNDSQAPK | 503 |
| Z16312 | VDAKYAKEVEKAQMEIFDLPNLTRKQYTAFIRKLLDDPSQSSELLSEAKKLNDSQAPK | 504 |
| Z16313 | VDAKYAKETYAAQMEIFSLPNLTRKQYTAFIRKLLDDPSQSSELLSEAKKLNDSQAPK | 505 |
| Z16314 | VDAKYAKELEAAYYEIYELPNLTRKQYTAFIRKLLDDPSQSSELLSEAKKLNDSQAPK | 506 |
| Z16315 | VDAKYAKEHVDAYFEIYALPNLTRKQYTAFIRKLLDDPSQSSELLSEAKKLNDSQAPK | 507 |
| Z16316 | VDAKYAKETIHAYDEIYGLPNLTRKQYTAFIRKLLDDPSQSSELLSEAKKLNDSQAPK | 508 |
| Z16317 | VDAKYAKEQEEAYWEIFQLPNLTRKQYTAFIRKLLDDPSQSSELLSEAKKLNDSQAPK | 509 |
| Z16318 | VDAKYAKEVEEAYYEIYALPNLTRKQYTAFIRKLLDDPSQSSELLSEAKKLNDSQAPK | 510 |
| Z16319 | VDAKYAKEIEEAQMEIFSLPNLTRKQYTAFIRKLFDDPSQSSELLSEAKKLNDSQAPK | 511 |
| Z16320 | VDAKYAKEVEDAYFEIYDLPNLTRKQYTAFIRKLLDDPSQSSELLSEAKKLNDSQAPK | 512 |
| Z16321 | VDAKYAKEIEEAQMEIYTLPNLTRKQYTAFIRKLLDDPSQSSELLSEAKKLNDSQAPK | 513 |
| Z16322 | VDAKYAKEVERAYFEIYDLPNLTRKQYTAFIRKLLDDPSQSSELLSEAKKLNDSQAPK | 514 |
| Z16324 | VDAKYAKEVVIAYHEIFKLPNLTRKQYTAFIRKLLDDPSQSSELLSEAKKLNDSQAPK | 515 |
| Z16325 | VDAKYAKEAYDAQMEIFGLPNLTRKQYTAFIRKLLDDPSQSSELLSEAKKLNDSQAPK | 516 |
| Z16327 | VDAKYAKEIIQAYYEIYHLPNLTRKQYTAFIRKLLDDPSQSSELLSEAKKLNDSQAPK | 517 |
| Z16328 | VDAKYAKEVVSAYFEIYQLPNLTRKQYTAFIRKLLDDPSQSSELLSEAKKLNDSQAPK | 518 |
| Z16329 | VDAKYAKEVEDAYFEIYKLPNLTRKQYTAFIRKLLDDPSQSSELLSEAKKLNDSQAPK | 519 |
| Z16330 | VDAKYAKEVVEAYHEIYSLPNLTRKQYTAFIRKLLDDPSQSSELLSEAKKLNDSQAPK | 520 |
| Z16331 | VDAKYAKEAEVAYYEIYSLPNLTRKQYTAFIRKLLDDPSQSSELLSEAKKLNDSQAPK | 521 |

FIGURE 1S

| | | |
|---|---|---|
| Z16332 | VDAKYAKEVEEAYMEIFGLPNLTRKQYTAFIRKLLDDPSQSSELLSEAKKLNDSQAPK | 522 |
| Z16333 | VDAKYAKEAEWAYFEIFKLPNLTRKQYTAFIRKLLDDPSQSSELLSEAKKLNDSQAPK | 523 |
| Z16334 | VDAKYAKEAEAAYWEIYALPNLTRKQYTAFIRKLLDDPSQSSELLSEAKKLNDSQAPK | 524 |
| Z16335 | VDAKYAKEAYVAYYEIYNLPNLTRKQYTAFIRKLLDDPSQSSELLSEAKKLNDSQAPK | 525 |
| Z16336 | VDAKYAKELEYAYHEIFALPNLTRKQYTAFIRKLLDDPSQSSELLSEAKKLNDSQAPK | 526 |
| Z16337 | VDAKYAKESESAYWEIYALPNLTRKQYTAFIRKLLDDPSQSSELLSEAKKLNDSQAPK | 527 |
| Z16338 | VDAKYAKEVEEAYQEIFNLPNLTRKQYTAFIRKLLDDPSQSSELLSEAKKLNDSQAPK | 528 |
| Z16339 | VDAKYAKEIEEAYMEIFNLPNLTRKQYTAFIRKLLDDPSQSSELLSEAKKLNDSQAPK | 529 |
| Z16340 | VDAKYAKEVVDAYSEIYLLPNLTRKQYTAFIRKLLDDPSQSSELLSEAKKLNDSQAPK | 530 |
| Z16341 | VDAKYAKELEAAQMEIFALPNLTRRQYTAFIRKLLDDPSQSSELLSEAKKLNDSQAPK | 531 |
| Z16342 | VDAKYAKEVEVAYMEIFELPNLTRKQYTAFIRKLLDDPSQSSELLSEAKKLNDSQAPK | 532 |
| Z16343 | VDAKYAKEVHEAYFEIFALPNLTRKQYTAFIRKLLDDPSQSSELLSEAKKLNDSQAPK | 533 |
| Z16344 | VDAKYAKEVENAYYEIYELPNLTRKQYTAFIRKLLDDPSQSSELLSEAKKLNDSQAPK | 534 |
| Z16345 | VDAKYAKEVEHAYYEIYRLPNLTRKQYTAFIRKLLDDPSQSSELLSEAKKLNDSQAPK | 535 |
| Z16346 | VDAKYAKEAEDAYMEIFHLPNLTRKQYTAFIRKLLDDPSQSSELLSEAKKLNDSQAPK | 536 |
| Z16347 | VDAKYAKETYAAQMEIYRLPNLTRKQYTAFIRKLLDDPSQSSELLSEAKKLNDSQAPK | 537 |
| Z16348 | VDAKYAKEAEYAYFEIFALPNLTRKQYTAFIRKLLDDPSQSSELLSEAKKLNDSQAPK | 538 |
| Z16349 | VDAKYAKEVVEAYYEIYEIYALPNLTRKQYTAFIRKLLDDPSQSSELLSEAKKLNDSQAPK | 539 |
| Z16351 | VDAKYAKEVVHAYFEIFSLPNLTRKQYTAFIRKLLDDPSQSSELLSEAKKLNDSQAPK | 540 |
| Z16352 | VDAKYAKEIENAQMEIFYLPNLTRRQYTAFIRKLLDDPSQSSELLSEAKKLNDSQAPK | 541 |
| Z16353 | VDAKYAKEVEAAYFEIYTLPNLTRKQYTAFIRKLLDDPSQSSELLSEAKKLNDSQAPK | 542 |
| Z16354 | VDAKYAKETLHAYDEIYQLPNLTRKQYTAFIRKLLDDPSQSSELLSEAKKLNDSQAPK | 543 |
| Z16356 | VDAKYAKEVEEAYMEIFRLPNLTRKQYTAFIRKLLDDPSQSSELLSEAKKLNDSQAPK | 544 |
| Z16357 | VDAKYAKEVEAQMEIFNLPNLTRKQYTAFIRKLLDDPSQSSELLSEAKKLNDSQAPK | 545 |
| Z16358 | VDAKYAKETVDAYYEIYALPNLTRKQYTAFIRKLLDDPSQSSELLSEAKKLNDSQAPK | 546 |
| Z16360 | VDAKYAKEAEEAYFEIYGLPNLTRKQYTAFIRKLLDDPSQSSELLSEAKKLNDSQAPK | 547 |
| Z16361 | VDAKYAKEIEIAQMEIFTLPNLTRKQYTAFIRKLLDDPSQSSELLSEAKKLNDSQAPK | 548 |
| Z16362 | VDAKYAKEVEIAYFEIFALPNLTRKQYTAFIRKLLDDPSQSSELLSEAKKLNDSQAPK | 549 |
| Z16363 | VDAKYAKEVEQAQMEIFRLPNLTRKQYTAFIRKLLDDPSQSSELLSEAKKLNDSQAPK | 550 |

FIGURE 1T

| | | |
|---|---|---|
| Z16364 | VDAKYAKEVQDAYWEIYQLPNLTRKQYTAFIRKLLDDPSQSSELLSEAKKLNDSQAPK | 551 |
| Z16365 | VDAKYAKETEEAYWEIYALPNLTRKQYTAFIRKLLDDPSQSSELLSEAKKLNDSQAPK | 552 |
| Z16366 | VDAKYAKEVEAAYFEIYALPNLTRKQYTAFIRKLLDDPSQSSELLSEAKKLNDSQAPK | 553 |
| Z16367 | VDAKYAKEIEDAQMEIFGLPNLTRKQYTAFIRKLLDDPSQSSELLSEAKKLNDSQAPK | 554 |
| Z16368 | VDAKYAKEVEVAYFEIFHLPNLTRKQYTAFIRKLLDDPSQSSELLSEAKKLNDSQAPK | 555 |
| Z16369 | VDAKYAKEIETAYMEIYRLPNLTRKQYTAFIRKLLDDPSQSSELLSEAKKLNDSQAPK | 556 |
| Z16370 | VDAKYAKEADAAYWEIYALPNLTRKQYTAFIRKLLDDPSQSSELLSEAKKLNDSQAPK | 557 |
| Z16371 | VDAKYAKEVEQAYYEIYHLPNLTRKQYTAFIRKLLDDPSQSSELLSEAKKLNDSQAPK | 558 |
| Z16372 | VDAKYAKEIEKAYYEIYELPNLTRKQYTAFIRKLLDDPSQSSELLSEAKKLNDSQAPK | 559 |
| Z16373 | VDAKYAKEVAAYYEIYGLPNLTRKQYTAFIRKLLDDPSQSSELLSEAKKLNDSQAPK | 560 |
| Z16376 | VDAKYAKEVVSAYYEIYNLPNLTRKQYTAFIRKLLDDPSQSSELLSEAKKLNDSQAPK | 561 |
| Z16377 | VDAKYAKETERAQMEIFYLPNLTRKQYTAFIRKLLDDPSQSSELLSEAKKLNDSQAPK | 562 |
| Z16378 | VDAKYAKEVESAYFEIFKLPNLTRKQYTAFIRKLLDDPSQSSELLSEAKKLNDSQAPK | 563 |
| Z16379 | VDAKYAKEVEKAYMEIYALPNLTRKQYTAFIRKLLDDPSQSSELLSEAKKLNDSQAPK | 564 |
| Z16380 | VDAKYAKETEDAYMEIYELPNLTRKQYTAFIRKLLDDPSQSSELLSEAKKLNDSQAPK | 565 |
| Z16381 | VDAKYAKEAEAEFEIYNLPNLTRKQYTAFIRKLLDDPSQSSELLSEAKKLNDSQAPK | 566 |
| Z16382 | VDAKYAKETLEAYDEIYQLPNLTRKQYTAFIRKLLDDPSQSSELLSEAKKLNDSQAPK | 567 |
| Z16383 | VDAKYAKELEVAYMEIFHLPNLTRKQYTAFIRKLLDDPSQSSELLSEAKKLNDSQAPK | 568 |
| Z16384 | VDAKYAKEVEIAQMEIFGLPNLTRKQYTAFIRKLLDDPSQSSELLSEAKKLNDSQAPK | 569 |
| Z16385 | VDAKYAKEVVEAYQEIFHLPNLTRRQYTAFIRKLLDDPSQSSELLSEAKKLNDSQAPK | 570 |
| Z16386 | VDAKYAKEAEEAYYETYGLPNLTRRQYTAFIRKLLDDPSQSSELLSEAKKLNDSQAPK | 571 |
| Z16387 | VDAKYAKEVEAAYMEIFHLPNLTRKQYTAFIRKLLDDPSQSSELLSEAKKLNDSQAPK | 572 |
| Z16388 | VDAKYAKEHEDAYMEIYALPNLTRKQYTAFIRKLLDDPSQSSELLSEAKKLNDSQAPK | 573 |
| Z16389 | VDAKYAKELEKAYFEIYNLPNLTRKQYTAFIRKLLDDPSQSSELLSEAKKLNDSQAPK | 574 |
| Z16390 | VDAKYAKEVEIAQMEIFALPNLTRKQYTAFIRKLLDDPSQSSELLSEAKKLNDSQAPK | 575 |
| Z16391 | VDAKYAKEVELAYMEIFNLPNLTRKQYTAFIRKLLDDPSQSSELLSEAKKLNDSQAPK | 576 |
| Z16392 | VDAKYAKEVFEAQMEIYELPNLTRKQYTAFIRKLLDDPSQSSELLSEAKKLNDSQAPK | 577 |
| Z16393 | VDAKYAKEVEDAYMEIYELPNLTRKQYTAFIRKLLDDPSQSSELLSEAKKLNDSQAPK | 578 |
| Z16394 | VDAKYAKETESAYFEIFKLPNLTRKQYTAFIRKLLDDPSQSSELLSEAKKLNDSQAPK | 579 |

FIGURE 1U

| | | |
|---|---|---|
| Z16395 | VDAKYAKELEEAYFEIYELPNLTRKQYTAFIRKLLDDPSQSSELLSEAKKLNDSQAPK | 580 |
| Z16396 | VDAKYAKEVVTAYQEIYELPNLTRKQYTAFIRKLLDDPSQSSELLSEAKKLNDSQAPK | 581 |
| Z16397 | VDAKYAKEVEAAYFEIYELPNLTRKQYTAFIRKLLDDPSQSSELLSEAKKLNDSQAPK | 582 |
| Z16398 | VDAKYAKEVEWAYMEIYHLPNLTRKQYTAFIRKLLDDPSQSSELLSEAKKLNDSQAPK | 583 |
| Z16399 | VDAKYAKETEYAYWEIYALPNLTRKQYTAFIRKLLDDPSQSSELLSEAKKLNDSQAPK | 584 |
| Z16400 | VDAKYAKEVETAYMEIYNLPNLTRKQYTAFIRKLLDDPSQSSELLSEAKKLNDSQAPK | 585 |
| Z16401 | VDAKYAKEVEFAYMEIYNLPNLTRKQYTAFIRKLLDDPSQSSELLSEAKKLNDSQAPK | 586 |
| Z16402 | VDAKYAKEVEAAYFEIFALPNLTRKQYTAFIRKLLDDPSQSSELLSEAKKLNDSQAPK | 587 |
| Z16403 | VDAKYAKEVERAYMEIFHLPNLTRKQYTAFIRKLLDDPSQSSELLSEAKKLNDSQAPK | 588 |
| Z16404 | VDAKYAKETVIAYFEIFKLPNLTRKQYTAFIRKLLDDPSQSSELLSEAKKLNDSQAPK | 589 |
| Z16405 | VDAKYAKETEDAYFEIYHLPNLTRKQYTAFIRKLLDDPSQSSELLSEAKKLNDSQAPK | 590 |
| Z16406 | VDAKYAKEADSAYWEIYALPNLTRKQYTAFIRKLLDDPSQSSELLSEAKKLNDSQAPK | 591 |
| Z16407 | VDAKYAKEVELAQMEIFALPNLTRKQYTAFIRKLLDDPSQSSELLSEAKKLNDSQAPK | 592 |
| Z16409 | VDAKYAKEVEQAYFEIYDLPNLTRKQYTAFIRKLLDDPSQSSELLSEAKKLNDSQAPK | 593 |
| Z16410 | VDAKYAKEAVDAYYEIYHLPNLTRKQYTAFIRKLLDDPSQSSELLSEAKKLNDSQAPK | 594 |
| Z16411 | VDAKYAKELQEAYMEIYHLPNLTRKQYTAFIRKLLDDPSQSSELLSEAKKLNDSQAPK | 595 |
| Z16412 | VDAKYAKEHVDAYMEIYALPNLTRKQYTAFIRKLLDDPSQSSELLSEAKKLNDSQAPK | 596 |
| Z16413 | VDAKYAKEVEHAYEEIYALPNLTRRQYTAFIRKLLDDPSQSSELLSEAKKLNDSQAPK | 597 |
| Z16414 | VDAKYAKEVVVAYHEIFALPNLTRKQYTAFIRKLLDDPSQSSELLSEAKKLNDSQAPK | 598 |
| Z16415 | VDAKYAKEHWKAYLEIYALPNLTRKQYTAFIRKLLDDPSQSSELLSEAKKLNDSQAPK | 599 |
| Z16416 | VDAKYAKEVYDAQMEIFALPNLTRKQYTAFIRKLLDDPSQSSELLSEAKKLNDSQAPK | 600 |
| Z16417 | VDAKYAKEVEAAYMEIYGLPNLTRKQYTAFIRKLLDDPSQSSELLSEAKKLNDSQAPK | 601 |
| Z16418 | VDAKYAKEHLTAYYEIYALPNLTRKQYTAFIRKLLDDPSQSSELLSEAKKLNDSQAPK | 602 |
| Z16419 | VDAKYAKEVKDAYFEIFELPNLTRKQYTAFIRKLLDDPSQSSELLSEAKKLNDSQAPK | 603 |
| Z16420 | VDAKYAKETEYAQMEIFALPNLTRKQYTAFIRKLLDDPSQSSELLSEAKKLNDSQAPK | 604 |
| Z16421 | VDAKYAKEIEDAYMEIYHLPNLTRKQYTAFIRKLLDDPSQSSELLSEAKKLNDSQAPK | 605 |
| Z16422 | VDAKYAKELEEAYYEIYDLPNLTRKQYTAFIRKLLDDPSQSSELLSEAKKLNDSQAPK | 606 |
| Z16423 | VDAKYAKETENAYMEIYHLPNLTRKQYTAFIRKLLDDPSQSSELLSEAKKLNDSQAPK | 607 |
| Z16424 | VDAKYAKEIESAYFEIYELPNLTRKQYTAFIRKLLDDPSQSSELLSEAKKLNDSQAPK | 608 |

FIGURE 1V

| | | |
|---|---|---|
| Z16425 | VDAKYAKEVYIAQMEIFRLPNLTRKQYTAFIRKLLDDPSQSSELLSEAKKLNDSQAPK | 609 |
| Z16426 | VDAKYAKEVEEAYFEIFALPNLTRRQYTAFIRKLLDDPSQSSELLSEAKKLNDSQAPK | 610 |
| Z16427 | VDAKYAKEAINAHHEIFLLPNLTRKQYTAFIRKLFDDPSQSSELLSEAKKLNDSQAPK | 611 |
| Z16428 | VDAKYAKEIEDAQMEIYRLPNLTRKQYTAFIRKLLDDPSQSSELLSEAKKLNDSQAPK | 612 |
| Z16429 | VDAKYAKEAYEAQMEIFSLPNLTRKQYTAFIRKLLDDPSQSSELLSEAKKLNDSQAPK | 613 |
| Z16430 | VDAKYAKEAEDAYMEIYHLPNLTRKQYTAFIRKLLDDPSQSSELLSEAKKLNDSQAPK | 614 |
| Z16431 | VDAKYAKEVEQAYFEIYSLPNLTRKQYTAFIRKLLDDPSQSSELLSEAKKLNDSQAPK | 615 |
| Z16432 | VDAKYAKEIEEAQMEIYFLPNLTRKQYTAFIRKLLDDPSQSSELLSEAKKLNDSQAPK | 616 |
| Z16433 | VDAKYAKETVSAYFEIYNLPNLTRKQYTAFIRKLLDDPSQSSELLSEAKKLNDSQAPK | 617 |
| Z16434 | VDAKYAKETEEAYFEIYNLPNLTRKQYTAFIRKLLDDPSQSSELLSEAKKLNDSQAPK | 618 |
| Z16435 | VDAKYAKEADRAYWEIYALPNLTRKQYTAFIRKLLDDPSQSSELLSEAKKLNDSQAPK | 619 |
| Z16436 | VDAKYAKETYKAQQEIYKLPNLTRKQYTAFIRKLLDDPSQSSELLSEAKKLNDSQAPK | 620 |
| Z16437 | VDAKYAKEVEVAYWEIFNLPNLTRKQYTAFIRKLLDDPSQSSELLSEAKKLNDSQAPK | 621 |
| Z16438 | VDAKYAKELERAYYEIYDLPNLTRKQYTAFIRKLLDDPSQSSELLSEAKKLNDSQAPK | 622 |
| Z16439 | VDAKYAKEAIDAYWEIYHLPNLTRKQYTAFIRKLLDDPSQSSELLSEAKKLNDSQAPK | 623 |
| Z16440 | VDAKYAKEVESAYMEIFHLPNLTRKQYTAFIRKLLDDPSQSSELLSEAKKLNDSQAPK | 624 |
| Z16441 | VDAKYAKEAENAYFEIYELPNLTRKQYTAFIRKLLDDPSQSSELLSEAKKLNDSQAPK | 625 |
| Z16442 | VDAKYAKEADAAYWEIYSLPNLTRKQYTAFIRKLLDDPSQSSELLSEAKKLNDSQAPK | 626 |
| Z16443 | VDAKYAKEATEAYMEIFALPNLTRKQYTAFIRKLLDDPSQSSELLSEAKKLNDSQAPK | 627 |
| Z16444 | VDAKYAKEVHDAYFEIYDLPNLTRKQYTAFIRKLLDDPSQSSELLSEAKKLNDSQAPK | 628 |
| Z16446 | VDAKYAKELEFAYQEIFSLPNLTRKQYTAFIRKLLDDPSQSSELLSEAKKLNDSQAPK | 629 |
| Z16447 | VDAKYAKEHVAAYFEIYRLPNLTRKQYTAFIRKLLDDPSQSSELLSEAKKLNDSQAPK | 630 |
| Z16448 | VDAKYAKEVEVAYMEIFALPNLTRKQYTAFIRKLLDDPSQSSELLSEAKKLNDSQAPK | 631 |
| Z16449 | VDAKYAKEVEQAYSEIFNLPNLTRKQYTAFIRKLLDDPSQSSELLSEAKKLNDSQAPK | 632 |
| Z16450 | VDAKYAKEAEVAYMEIFALPNLTRKQYTAFIRKLLDDPSQSSELLSEAKKLNDSQAPK | 633 |
| Z16451 | VDAKYAKEVEIAYYEIFALPNLTRKQYTAFIRKLLDDPSQSSELLSEAKKLNDSQAPK | 634 |
| Z16452 | VDAKYAKEVENAYYEIYQLPNLTRKQYTAFIRKLLDDPSQSSELLSEAKKLNDSQAPK | 635 |
| Z16453 | VDAKYAKEAYEAQMEIFALPNLTRKQYTAFIRKLLDDPSQSSELLSEAKKLNDSQAPK | 636 |
| Z16454 | VDAKYAKEADQAYWEIYALPNLTRKQYTAFIRKLLDDPSQSSELLSEAKKLNDSQAPK | 637 |

FIGURE 1W

| | | |
|---|---|---|
| Z16455 | VDAKYAKELHHAYDEIFQLPNLTRKQYTAFIRKLLDDPSQSSELLSEAKKLNDSQAPK | 638 |
| Z16456 | VDAKYAKEVEEAYQEIFHLPNLTRRQYTAFIRKLLDDPSQSSELLSEAKKLNDSQAPK | 639 |
| Z16457 | VDAKYAKEVEAAYYEIFSLPNLTRKQYTAFIRKLLDDPSQSSELLSEAKKLNDSQAPK | 640 |
| Z16458 | VDAKYAKEVEIAQYEIFALPNLTRKQYTAFIRKLLDDPSQSSELLSEAKKLNDSQAPK | 641 |
| Z16459 | VDAKYAKEVEEAYFEIYDLPNLTRKQYTAFIRKLLDDPSQSSELLSEAKKLNDSQAPK | 642 |
| Z16460 | VDAKYAKETESAYWEIYKLPNLTRKQYTAFIRKLLDDPSQSSELLSEAKKLNDSQAPK | 643 |
| Z16461 | VDAKYAKEVERAYYEIFELPNLTRKQYTAFIRKLLDDPSQSSELLSEAKKLNDSQAPK | 644 |
| Z16462 | VDAKYAKEAEEAYMEIFALPNLTRKQYTAFIRKLLDDPSQSSELLSEAKKLNDSQAPK | 645 |
| Z16463 | VDAKYAKEVERAQMEIFELPNLTRKQYTAFIRKLLDDPSQSSELLSEAKKLNDSQAPK | 646 |
| Z16464 | VDAKYAKETEQAYMEIYALPNLTRKQYTAFIRKLLDDPSQSSELLSEAKKLNDSQAPK | 647 |
| Z16465 | VDAKYAKEVERAYFEIFALPNLTRKQYTAFIRKLLDDPSQSSELLSEAKKLNDSQAPK | 648 |
| Z16466 | VDAKYAKEVEQAYFEIFEIPNLTRKQYTAFIRKLLDDPSQSSELLSEAKKLNDSQAPK | 649 |
| Z16467 | VDAKYAKEVQKAYFEIYDLPNLTRKQYTAFIRKLLDDPSQSSELLSEAKKLNDSQAPK | 650 |
| Z16468 | VDAKYAKEVEAAYMEIYELPNLTRKQYTAFIRKLLDDPSQSSELLSEAKKLNDSQAPK | 651 |
| Z16469 | VDAKYAKEVEEAYFEIYALPNLTRKQYTAFIRKLLDDPSQSSELLSEAKKLNDSQAPK | 652 |
| Z16470 | VDAKYAKELEDAYMEIYSLPNLTRKQYTAFIRKLLDDPSQSSELLSEAKKLNDSQAPK | 653 |
| Z16471 | VDAKYAKEVVDAYDEIFHLPNLTRKQYTAFIRKLLDDPSQSSELLSEAKKLNDSQAPK | 654 |
| Z16472 | VDAKYAKEVVDAYDEIFRLPNLTRKQYTAFIRKLLDDPSQSSELLSEAKKLNDSQAPK | 655 |
| Z16473 | VDAKYAKEVEDAYEEIYALPNLTRKQYTAFIRKLLDDPSQSSELLSEAKKLNDSQAPK | 656 |
| Z16474 | VDAKYAKEAEEAYWEIYELPNLTRKQYTAFIRKLLDDPSQSSELLSEAKKLNDSQAPK | 657 |
| Z16475 | VDAKYAKEVEVAQMEIFDLPNLTRKQYTAFIRKLLDDPSQSSELLSEAKKLNDSQAPK | 658 |
| Z16476 | VDAKYAKEVEVAQMEIFGLPNLTRKQYTAFIRKLLDDPSQSSELLSEAKKLNDSQAPK | 659 |
| Z16477 | VDAKYAKELEAAQMEIFELPNLTRKQYTAFIRKLLDDPSQSSELLSEAKKLNDSQAPK | 660 |
| Z16478 | VDAKYAKEVEEAYFEIYNLPNLTRKQYTAFIRKLLDDPSQSSELLSEAKKLNDSQAPK | 661 |
| Z16479 | VDAKYAKEVEQAYMEIYELPNLTRKQYTAFIRKLLDDPSQSSELLSEAKKLNDSQAPK | 662 |
| Z16480 | VDAKYAKEVHDAYEEIFILPNLTRKQYTAFIRKLLDDPSQSSELLSEAKKLNDSQAPK | 663 |
| Z16481 | VDAKYAKEVEVAYMEIFNLPNLTRKQYTAFIRKLLDDPSQSSELLSEAKKLNDSQAPK | 664 |
| Z16482 | VDAKYAKEAEHAYFEIFALPNLTRKQYTAFIRKLLDDPSQSSELLSEAKKLNDSQAPK | 665 |
| Z16483 | VDAKYAKEIEVAQMEIYNLPNLTRKQYTAFIRKLLDDPSQSSELLSEAKKLNDSQAPK | 666 |

FIGURE 1X

| | | |
|---|---|---|
| Z16484 | VDAKYAKEAEDAYMEIYALPNLTRKQYTAFIRKLLDDPSQSSELLSEAKKLNDSQAPK | 667 |
| Z16485 | VDAKYAKEVEHAYFEIFALPNLTRKQYTAFIRKLLDDPSQSSELLSEAKKLNDSQAPK | 668 |
| Z16486 | VDAKYAKETENAYFEIYHLPNLTRKQYTAFIRKLLDDPSQSSELLSEAKKLNDSQAPK | 669 |
| Z16487 | VDAKYAKEVEQAYFEIFALPNLTRKQYTAFIRKLLDDPSQSSELLSEAKKLNDSQAPK | 670 |
| Z16488 | VDAKYAKEAEDAYMEIYSLPNLTRKQYTAFIRKLLDDPSQSSELLSEAKKLNDSQAPK | 671 |
| Z16489 | VDAKYAKEVEDAYEEIYQLPNLTRKQYTAFIRKLLDDPSQSSELLSEAKKLNDSQAPK | 672 |
| Z16490 | VDAKYAKYAKELESAYFEIYGLPNLTRKQYTAFIRRQYTAFIRKLLDDPSQSSELLSEAKKLNDSQAPK | 673 |
| Z16491 | VDAKYAKEVVTAYYEIFELPNLTRKQYTAFIRKLLDDPSQSSELLSEAKKLNDSQAPK | 674 |
| Z16492 | VDAKYAKEQEDAYWEIYGLPNLTRKQYTAFIRKLLDDPSQSSELLSEAKKLNDSQAPK | 675 |
| Z16493 | VDAKYAKEVQAAYFEIFALPNLTRKQYTAFIRRQYTAFIRKLLDDPSQSSELLSEAKKLNDSQAPK | 676 |
| Z16494 | VDAKYAKEAVNAYFEIYELPNLTRKQYTAFIRKLLDDPSQSSELLSEAKKLNDSQAPK | 677 |
| Z16495 | VDAKYAKEVEHAQMEIYGLPNLTRKQYTAFIRKLLDDPSQSSELLSEAKKLNDSQAPK | 678 |
| Z16496 | VDAKYAKEVEAAYFFEIYSLPNLTRKQYTAFIRKLLDDPSQSSELLSEAKKLNDSQAPK | 679 |
| Z16497 | VDAKYAKEIEIAQMEIFALPNLTRKQYTAFIRKLLDDPSQSSELLSEAKKLNDSQAPK | 680 |
| Z16498 | VDAKYAKELENAYFEIYGLPNLTRKQYTAFIRKLLDDPSQSSELLSEAKKLNDSQAPK | 681 |
| Z16499 | VDAKYAKEVEAAYFEIYNLPNLTRKQYTAFIRKLLDDPSQSSELLSEAKKLNDSQAPK | 682 |
| Z16500 | VDAKYAKELEWAQMEIFYLPNLTRKQYTAFIRKLLDDPSQSSELLSEAKKLNDSQAPK | 683 |
| Z16501 | VDAKYAKEADDAYWEIYALPNLTRKQYTAFIRKLLDDPSQSSELLSEAKKLNDSQAPK | 684 |
| Z16502 | VDAKYAKEVELAQMEIHEAQMEIFKLPNLTRRQYTAFIRKLLDDPSQSSELLSEAKKLNDSQAPK | 685 |
| Z16503 | VDAKYAKEIHEAQMEIFKLPNLTRKQYTAFIRKLLDDPSQSSELLSEAKKLNDSQAPK | 686 |
| Z16505 | VDAKYAKEVEYAYFEIFKLPNLTRKQYTAFIRKLLDDPSQSSELLSEAKKLNDSQAPK | 687 |
| Z16506 | VDAKYAKEAYTAQMEIFSLPNLTRKQYTAFIRKLLDDPSQSSELLSEAKKLNDSQAPK | 688 |
| Z16507 | VDAKYAKEAENAYWEIYALPNLTRKQYTAFIRKLLDDPSQSSELLSEAKKLNDSQAPK | 689 |
| Z16509 | VDAKYAKEVERAYMEIFGLPNLTRKQYTAFIRKLLDDPSQSSELLSEAKKLNDSQAPK | 690 |
| Z16510 | VDAKYAKEIEEAQMEIFWLPNLTRKQYTAFIRKLLDDPSQSSELLSEAKKLNDSQAPK | 691 |
| Z16511 | VDAKYAKEIEDAYMEIYALPNLTRKQYTAFIRKLLDDPSQSSELLSEAKKLNDSQAPK | 692 |
| Z16512 | VDAKYAKEVVKAYYEIYELPNLTRKQYTAFIRKLLDDPSQSSELLSEAKKLNDSQAPK | 693 |
| Z16513 | VDAKYAKELENAYAEIFHLPNLTRKQYTAFIRKLLDDPSQSSELLSEAKKLNDSQAPK | 694 |
| Z16514 | VDAKYAKEQISAYWEIYALPNLTRKQYTAFIRKLLDDPSQSSELLSEAKKLNDSQAPK | 695 |

FIGURE 1Y

| | | |
|---|---|---|
| Z16515 | VDAKYAKETEDAYMEIYNLPNLTRKQYTAFIRKLLDDPSQSSELLSEAKKLNDSQAPK | 696 |
| Z16516 | VDAKYAKEVEDAYMEIYNLPNLTRKQYTAFIRKLLDDPSQSSELLSEAKKLNDSQAPK | 697 |
| Z16517 | VDAKYAKEVEDAQYEIFDLPNLTRKQYTAFIRKLLDDPSQSSELLSEAKKLNDSQAPK | 698 |
| Z16518 | VDAKYAKEVERAQMEIFDLPNLTRKQYTAFIRKLFDDPSQSSELLSEAKKLNDSQAPK | 699 |
| Z16519 | VDAKYAKEAHEAQMEIFYLPNLTRKQYTAFIRKLLDDPSQSSELLSEAKKLNDSQAPK | 700 |
| Z16520 | VDAKYAKETYNAQQEIFNLPNLTRRQYTAFIRKLLDDPSQSSELLSEAKKLNDSQAPK | 701 |
| Z16521 | VDAKYAKEVEDAQLEIFALPNLTRKQYTAFIRKLLDDPSQSSELLSEAKKLNDSQAPK | 702 |
| Z16522 | VDAKYAKEIEKAQMEIFFLPNLTRKQYTAFIRKLFDDPSQSSELLSEAKKLNDSQAPK | 703 |
| Z16523 | VDAKYAKEIEKAQMEIFGLPNLTRKQYTAFIRKLLDDPSQSSELLSEAKKLNDSQAPK | 704 |
| Z16524 | VDAKYAKEVELAQMEIFALPNLTRKQYTAFIRKLFDDPSQSSELLSEAKKLNDSQAPK | 705 |
| Z16525 | VDAKYAKEVEHAQMEIFNLPNLTRKQYTAFIRKLLDDPSQSSELLSEAKKLNDSQAPK | 706 |
| Z16526 | VDAKYAKETESAQMEIFGLPNLTRKQYTAFIRKLLDDPSQSSELLSEAKKLNDSQAPK | 707 |
| Z16527 | VDAKYAKEIEVAQLEIFKLPNLTRKQYTAFIRKLFDDPSQSSELLSEAKKLNDSQAPK | 708 |
| Z16528 | VDAKYAKEVETAQMEIFALPNLTRRQYTAFIRKLLDDPSQSSELLSEAKKLNDSQAPK | 709 |
| Z16529 | VDAKYAKELESAQMEIFYLPNLTRKQYTAFIRKLLDDPSQSSELLSEAKKLNDSQAPK | 710 |
| Z16530 | VDAKYAKETEEAQMEIFGLPNLTRKQYTAFIRKLLDDPSQSSELLSEAKKLNDSQAPK | 711 |
| Z16531 | VDAKYAKEVEVAQMEIFNLPNLTRKQYTAFIRKLLDDPSQSSELLSEAKKLNDSQAPK | 712 |
| Z16532 | VDAKYAKEVIVAYEEIFQLPNLTRKQYTAFIRKLLDDPSQSSELLSEAKKLNDSQAPK | 713 |
| Z16533 | VDAKYAKEVETAQMEIFSLPNLTRKQYTAFIRKLLDDPSQSSELLSEAKKLNDSQAPK | 714 |
| Z16534 | VDAKYAKEIEAAQMEIFNLPNLTRKQYTAFIRKLLDDPSQSSELLSEAKKLNDSQAPK | 715 |
| Z16535 | VDAKYAKELEKAQMEIFKLPNLTRKQYTAFIRKLLDDPSQSSELLSEAKKLNDSQAPK | 716 |
| Z16536 | VDAKYAKETESAQMEIFALPNLTRKQYTAFIRKLLDDPSQSSELLSEAKKLNDSQAPK | 717 |
| Z16537 | VDAKYAKELESAQMEIFALPNLTRKQYTAFIRKLFDDPSQSSELLSEAKKLNDSQAPK | 718 |
| Z16538 | VDAKYAKETEDAQMEIYRLPNLTRKQYTAFIRKLLDDPSQSSELLSEAKKLNDSQAPK | 719 |
| Z16539 | VDAKYAKEIYVAQMEIFGLPNLTRKQYTAFIRKLLDDPSQSSELLSEAKKLNDSQAPK | 720 |
| Z16540 | VDAKYAKETEQAQMEIFSLPNLTRRQYTAFIRKLLDDPSQSSELLSEAKKLNDSQAPK | 721 |
| Z16541 | VDAKYAKEAYKAQMEIFKLPNLTRKQYTAFIRKLLDDPSQSSELLSEAKKLNDSQAPK | 722 |
| Z16542 | VDAKYAKEIEDAQMEIFELPNLTRRQYTAFIRKLLDDPSQSSELLSEAKKLNDSQAPK | 723 |
| Z16543 | VDAKYAKEVEIAQMEIFNLPNLTRKQYTAFIRKLLDDPSQSSELLSEAKKLNDSQAPK | 724 |

FIGURE 1Z

| ID | Sequence | # |
|---|---|---|
| Z16544 | VDAKYAKEVEFAYMEIFRLPNLTRKQYTAFIRKLLDDPSQSSELLSEAKKLNDSQAPK | 725 |
| Z16545 | VDAKYAKEIERAQMEIYELPNLTRKQYTAFIRKLFDDPSQSSELLSEAKKLNDSQAPK | 726 |
| Z16546 | VDAKYAKEVDEAYMEIYNLPNLTRRQYTAFIRKLLDDPSQSSELLSEAKKLNDSQAPK | 727 |
| Z16547 | VDAKYAKEVEEAQLEIFALPNLTRKQYTAFIRKLFDDPSQSSELLSEAKKLNDSQAPK | 728 |
| Z16548 | VDAKYAKETHDAQMEIFELPNLTRKQYTAFIRKLFDDPSQSSELLSEAKKLNDSQAPK | 729 |
| Z16549 | VDAKYAKETEDAQMEIFGLPNLTRKQYTAFIRKLLDDPSQSSELLSEAKKLNDSQAPK | 730 |
| Z16550 | VDAKYAKETERAYYEIFALPNLTRKQYTAFIRKLLDDPSQSSELLSEAKKLNDSQAPK | 731 |
| Z16551 | VDAKYAKEVEDAQMEIYYLPNLTRRQYTAFIRKLLDDPSQSSELLSEAKKLNDSQAPK | 732 |
| Z16552 | VDAKYAKEAEQAYFEIYELPNLTRKQYTAFIRKLLDDPSQSSELLSEAKKLNDSQAPK | 733 |
| Z16554 | VDAKYAKEVEEAQMEIFNLPNLTRKQYTAFIRKLLDDPSQSSELLSEAKKLNDSQAPK | 734 |
| Z16555 | VDAKYAKEVEVAQMEIFNLPNLTRKQYTAFIRKLLDDPSQSSELLSEAKKLNDSQAPK | 735 |
| Z16556 | VDAKYAKEIEQAQMEIYFLPNLTRKQYTAFIIKLFDDPSQSSELLSEAKKLNDSQAPK | 736 |
| Z16557 | VDAKYAKEVEWAQMEIFYLPNLTRKQYTAFIRKLLDDPSQSSELLSEAKKLNDSQAPK | 737 |
| Z16558 | VDAKYAKEVESAQMEIFKLPNLTRKQYTAFIRKLFDDPSQSSELLSEAKKLNDSQAPK | 738 |
| Z16559 | VDAKYAKEAEVAQMEIFALPNLTRKQYTAFIRKLLDDPSQSSELLSEAKKLNDSQAPK | 739 |
| Z16560 | VDAKYAKEIEKAQMEIYYLPNLTRKQYTAFIRKLLDDPSQSSELLSEAKKLNDSQAPK | 740 |
| Z16561 | VDAKYAKEIEKAQLEIFALPNLTRKQYTAFIRKLLDDPSQSSELLSEAKKLNDSQAPK | 741 |
| Z16562 | VDAKYAKETERAQMEIFQLPNLTRKQYTAFIRKLLDDPSQSSELLSEAKKLNDSQAPK | 742 |
| Z16563 | VDAKYAKEVQDAQMEIFYLPNLTRRQYTAFIRKLLDDPSQSSELLSEAKKLNDSQAPK | 743 |
| Z16564 | VDAKYAKEIEAAQMEIFVLPNLTRKQYTAFIRKLLDDPSQSSELLSEAKKLNDSQAPK | 744 |
| Z16565 | VDAKYAKELQRAQMEIFELPNLTRKQYTAFIRKLLDDPSQSSELLSEAKKLNDSQAPK | 745 |
| Z16566 | VDAKYAKELEEAQMEIFLLPNLTRKQYTAFIRKLLDDPSQSSELLSEAKKLNDSQAPK | 746 |
| Z16567 | VDAKYAKEIEHAQMEIFALPNLTRKQYTAFIRKLLDDPSQSSELLSEAKKLNDSQAPK | 747 |
| Z16568 | VDAKYAKEVYQAQMEIFGLPNLTRKQYTAFIRKLLDDPSQSSELLSEAKKLNDSQAPK | 748 |
| Z16569 | VDAKYAKEIEAAQMEIFYLPNLTRRQYTAFIRKLLDDPSQSSELLSEAKKLNDSQAPK | 749 |
| Z16570 | VDAKYAKEAKDAQMEIFGLPNLTRRQYTAFIRKLLDDPSQSSELLSEAKKLNDSQAPK | 750 |
| Z16572 | VDAKYAKEVETAYMEIYLPNLTRKQYTAFIRKLLDDPSQSSELLSEAKKLNDSQAPK | 751 |
| Z16573 | VDAKYAKEVEEAAQMEIYALPNLTRKQYTAFIRKLLDDPSQSSELLSEAKKLNDSQAPK | 752 |
| Z16574 | VDAKYAKEVEAAYWEIFKLPNLTRKQYTAFIRKLLDDPSQSSELLSEAKKLNDSQAPK | 753 |

FIGURE 1AA

| | | |
|---|---|---|
| Z16575 | VDAKYAKEIEQAQMEIYELPNLTRKQYTAFIRKLLDDPSQSSELLSEAKKLNDSQAPK | 754 |
| Z16576 | VDAKYAKETEEAYFEIYELPNLTRKQYTAFIRKLLDDPSQSSELLSEAKKLNDSQAPK | 755 |
| Z16577 | VDAKYAKEVEWAQMEIFKLPNLTRRQYTAFIRKLLDDPSQSSELLSEAKKLNDSQAPK | 756 |
| Z16578 | VDAKYAKEIEIAQMEIFELPNLTRKQYTAFIRKLLDDPSQSSELLSEAKKLNDSQAPK | 757 |
| Z16579 | VDAKYAKEAEAAQMEIFALPNLTRKQYTAFIRKLLDDPSQSSELLSEAKKLNDSQAPK | 758 |
| Z16580 | VDAKYAKEVVSAYEEIFHLPNLTRKQYTAFIRKLLDDPSQSSELLSEAKKLNDSQAPK | 759 |
| Z16581 | VDAKYAKETEDAQMEIFALPNLTRRQYTAFIRKLLDDPSQSSELLSEAKKLNDSQAPK | 760 |
| Z16582 | VDAKYAKEVEFAQMEIFELPNLTRKQYTAFIRKLLDDPSQSSELLSEAKKLNDSQAPK | 761 |
| Z16583 | VDAKYAKEVQNAQMEIFALPNLTRKQYTAFIRKLLDDPSQSSELLSEAKKLNDSQAPK | 762 |
| Z16584 | VDAKYAKEAQRAYMEIYQLPNLTRKQYTAFIRKLLDDPSQSSELLSEAKKLNDSQAPK | 763 |
| Z16585 | VDAKYAKEIEDAQMEIYGLPNLTRKQYTAFIRKLFDDPSQSSELLSEAKKLNDSQAPK | 764 |
| Z16586 | VDAKYAKEVEYAQMEIFSLPNLTRKQYTAFIRKLFDDPSQSSELLSEAKKLNDSQAPK | 765 |
| Z16587 | VDAKYAKEAEDAQMEIFALPNLTRKQYTAFIRKLFDDPSQSSELLSEAKKLNDSQAPK | 766 |
| Z16588 | VDAKYAKEVESAQMEIFDLPNLTRKQYTAFIRKLFDDPSQSSELLSEAKKLNDSQAPK | 767 |
| Z16589 | VDAKYAKEVDVAYMEIFGLPNLTRKQYTAFIRKLLDDPSQSSELLSEAKKLNDSQAPK | 768 |
| Z16590 | VDAKYAKEVEDAQMEIFSLPNLTRKQYTAFIRKLFDDPSQSSELLSEAKKLNDSQAPK | 769 |
| Z16591 | VDAKYAKEVEAAQMEIFDLPNLTRKQYTAFIRKLLDDPSQSSELLSEAKKLNDSQAPK | 770 |
| Z16592 | VDAKYAKEVEDAYFEIYLLPNLTRKQYTAFIRKLLDDPSQSSELLSEAKKLNDSQAPK | 771 |
| Z16593 | VDAKYAKEVEKAQMEIFTLPNLTRKQYTAFIRKLFDDPSQSSELLSEAKKLNDSQAPK | 772 |
| Z16594 | VDAKYAKELEKAYFEIYELPNLTRKQYTAFIRKLFDDPSQSSELLSEAKKLNDSQAPK | 773 |
| Z16595 | VDAKYAKEAAAQMEIFALPNLTRKQYTAFIRKLFDDPSQSSELLSEAKKLNDSQAPK | 774 |
| Z16596 | VDAKYAKEIREAQMEIFGLPNLTRKQYTAFIRKLFDDPSQSSELLSEAKKLNDSQAPK | 775 |
| Z16597 | VDAKYAKEVENAQMEIYNLPNLTRKQYTAFIRKLFDDPSQSSELLSEAKKLNDSQAPK | 776 |
| Z16598 | VDAKYAKEVEDAQMEIYDLPNLTRKQYTAFIRKLFDDPSQSSELLSEAKKLNDSQAPK | 777 |
| Z16599 | VDAKYAKEVEVAQMEIFGLPNLTRRQYTAFIRKLLDDPSQSSELLSEAKKLNDSQAPK | 778 |
| Z16600 | VDAKYAKEVEHAQMEIYYLPNLTRKQYTAFIRKLLDDPSQSSELLSEAKKLNDSQAPK | 779 |
| Z16601 | VDAKYAKEAETAQMEIFALPNLTRKQYTAFIRKLFDDPSQSSELLSEAKKLNDSQAPK | 780 |
| Z16602 | VDAKYAKEIEQAQMEIFRLPNLTRKQYTAFIRKLLDDPSQSSELLSEAKKLNDSQAPK | 781 |
| Z16603 | VDAKYAKEVEAAQMEIFYLPNLTRKQYTAFIRKLFDDPSQSSELLSEAKKLNDSQAPK | 782 |

FIGURE 1AB

| ID | Sequence | # |
|---|---|---|
| Z16604 | VDAKYAKEVHEAQMEIFYLPNLTRRQYTAFIRKLLDDPSQSSELLSEAKKLNDSQAPK | 783 |
| Z16605 | VDAKYAKEVHEHAYMEIFHLPNLTRKQYTAFIRKLLDDPSQSSELLSEAKKLNDSQAPK | 784 |
| Z16606 | VDAKYAKEIEKAQMEIFDLPNLTRKQYTAFIRKLFDDPSQSSELLSEAKKLNDSQAPK | 785 |
| Z16607 | VDAKYAKETEAAQMEIYNLPNLTRKQYTAFIRKLFDDPSQSSELLSEAKKLNDSQAPK | 786 |
| Z16608 | VDAKYAKEVHEAQMEIYNLPNLTRKQYTAFIRKLLDDPSQSSELLSEAKKLNDSQAPK | 787 |
| Z16609 | VDAKYAKEIQDAQMEIYYLPNLTRKQYTAFIRKLLDDPSQSSELLSEAKKLNDSQAPK | 788 |
| Z16610 | VDAKYAKEVEQAQMEIFLLPNLTRKQYTAFIRKLLDDPSQSSELLSEAKKLNDSQAPK | 789 |
| Z16611 | VDAKYAKETEIAQMEIFELPNLTRKQYTAFIRKLLDDPSQSSELLSEAKKLNDSQAPK | 790 |
| Z16612 | VDAKYAKEIEEAQLEIFELPNLTRKQYTAFIRKLLDDPSQSSELLSEAKKLNDSQAPK | 791 |
| Z16613 | VDAKYAKELERAQMEIFVLPNLTRKQYTAFIRKLLDDPSQSSELLSEAKKLNDSQAPK | 792 |
| Z16614 | VDAKYAKETEIAQMEIYSLPNLTRKQYTAFIRKLLDDPSQSSELLSEAKKLNDSQAPK | 793 |
| Z16615 | VDAKYAKEAEDAYMEIFRLPNLTRKQYTAFIRKLLDDPSQSSELLSEAKKLNDSQAPK | 794 |
| Z16616 | VDAKYAKEVEQAQLEIFSLPNLTRKQYTAFIRKLFDDPSQSSELLSEAKKLNDSQAPK | 795 |
| Z16617 | VDAKYAKEIEFAQMEIFYLPNLTRKQYTAFIRKLLDDPSQSSELLSEAKKLNDSQAPK | 796 |
| Z16618 | VDAKYAKEIEEAQMEIFFLPNLTRKQYTAFIRKLLDDPSQSSELLSEAKKLNDSQAPK | 797 |
| Z16619 | VDAKYAKETYHAQMEIYSLPNLTRKQYTAFIRKLLDDPSQSSELLSEAKKLNDSQAPK | 798 |
| Z16620 | VDAKYAKEAEQAYHEIYQLPNLTRKQYTAFIRKLLDDPSQSSELLSEAKKLNDSQAPK | 799 |
| Z16621 | VDAKYAKETETAQMEIFSLPNLTRKQYTAFIRKLLDDPSQSSELLSEAKKLNDSQAPK | 800 |
| Z16622 | VDAKYAKEAEAYQEIFHLPNLTRKQYTAFIRKLLDDPSQSSELLSEAKKLNDSQAPK | 801 |
| Z16623 | VDAKYAKETEVAQMEIYELPNLTRKQYTAFIRKLLDDPSQSSELLSEAKKLNDSQAPK | 802 |
| Z16624 | VDAKYAKETAQMEIYELPNLTRKQYTAFIRKLFDDPSQSSELLSEAKKLNDSQAPK | 803 |
| Z16625 | VDAKYAKELERAQMEIFGLPNLTRKQYTAFIRKLLDDPSQSSELLSEAKKLNDSQAPK | 804 |
| Z16626 | VDAKYAKEVYAAYDEIYALPNLTRKQYTAFIRKLLDDPSQSSELLSEAKKLNDSQAPK | 805 |
| Z16627 | VDAKYAKEAEFAQMEIFYLPNLTRKQYTAFIRKLLDDPSQSSELLSEAKKLNDSQAPK | 806 |
| Z16628 | VDAKYAKEVQAAYYEIFALPNLTRKQYTAFIRKLLDDPSQSSELLSEAKKLNDSQAPK | 807 |
| Z16629 | VDAKYAKEVYNAQMEIFYLPNLTRKQYTAFIRKLLDDPSQSSELLSEAKKLNDSQAPK | 808 |
| Z16630 | VDAKYAKEAEIAQMEIYSLPNLTRKQYTAFIRKLLDDPSQSSELLSEAKKLNDSQAPK | 809 |
| Z16631 | VDAKYAKEVEVAQMEIFDLPNLTRRQYTAFIRKLFDDPSQSSELLSEAKKLNDSQAPK | 810 |
| Z16632 | VDAKYAKEVEQAQMEIYYLPNLTRKQYTAFIRKLFDDPSQSSELLSEAKKLNDSQAPK | 811 |

FIGURE 1AC

| ID | Sequence | # |
|---|---|---|
| Z16633 | VDAKYAKEVENAQMEIFGLPNLTRKQYTAFIRKLLDDPSQSSELLSEAKKLNDSQAPK | 812 |
| Z16634 | VDAKYAKEVEIAYIEIYKLPNLTRKQYTAFIRKLLDDPSQSSELLSEAKKLNDSQAPK | 813 |
| Z16635 | VDAKYAKEVEVAQFEIFALPNLTRKQYTAFIRKLLDDPSQSSELLSEAKKLNDSQAPK | 814 |
| Z16636 | VDAKYAKEIERAQMEIFYLPNLTRKQYTAFIRKLLDDPSQSSELLSEAKKLNDSQAPK | 815 |
| Z16637 | VDAKYAKEIEDAQMEIFHLPNLTRKQYTAFIRKLLDDPSQSSELLSEAKKLNDSQAPK | 816 |
| Z16638 | VDAKYAKEIENAQMEIFSLPNLTRKQYTAFIRKLLDDPSQSSELLSEAKKLNDSQAPK | 817 |
| Z16639 | VDAKYAKEIELEAAQMEIFGLPNLTRKQYTAFIRKLLDDPSQSSELLSEAKKLNDSQAPK | 818 |
| Z16640 | VDAKYAKEIERAQLEIFALPNLTRKQYTAFIRKLFDDPSQSSELLSEAKKLNDSQAPK | 819 |
| Z16641 | VDAKYAKETYRAQMEIFALPNLTRKQYTAFIRKLLDDPSQSSELLSEAKKLNDSQAPK | 820 |
| Z16642 | VDAKYAKEVEEAQMEIYSLPNLTRRQYTAFIRKLLDDPSQSSELLSEAKKLNDSQAPK | 821 |
| Z16643 | VDAKYAKEVEKAQMEIFALPNLTRKQYTAFIRKLLDDPSQSSELLSEAKKLNDSQAPK | 822 |
| Z16644 | VDAKYAKEAHAAYFEIYRLPNLTRKQYTAFIRKLLDDPSQSSELLSEAKKLNDSQAPK | 823 |
| Z16645 | VDAKYAKEIERAQMEIYYLPNLTRKQYTAFIRKLLDDPSQSSELLSEAKKLNDSQAPK | 824 |
| Z16646 | VDAKYAKELEAAQMEIFNLPNLTRKQYTAFIRKLLDDPSQSSELLSEAKKLNDSQAPK | 825 |
| Z16647 | VDAKYAKEVEVAQMEIFALPNLTRKQYTAFIRKLLDDPSQSSELLSEAKKLNDSQAPK | 826 |
| Z16648 | VDAKYAKEAEWAYMEIFKLPNLTRKQYTAFIRKLLDDPSQSSELLSEAKKLNDSQAPK | 827 |
| Z16649 | VDAKYAKETEYAQLEIFALPNLTRKQYTAFIRKLFDDPSQSSELLSEAKKLNDSQAPK | 828 |
| Z16650 | VDAKYAKEVEDAQMEIFRLPNLTRKQYTAFIRKLLDDPSQSSELLSEAKKLNDSQAPK | 829 |
| Z16652 | VDAKYAKEIEEAQMEIFGLPNLTRKQYTAFIRKLLDDPSQSSELLSEAKKLNDSQAPK | 830 |
| Z16653 | VDAKYAKEVERAQMEIFALPNLTRKQYTAFIRKLFDDPSQSSELLSEAKKLNDSQAPK | 831 |
| Z16654 | VDAKYAKEAEAAYYEIYALPNLTRRQYTAFIRKLLDDPSQSSELLSEAKKLNDSQAPK | 832 |
| Z16655 | VDAKYAKETEEAQMEIYRLPNLTRKQYTAFIRKLLDDPSQSSELLSEAKKLNDSQAPK | 833 |
| Z16656 | VDAKYAKETEDAYFEIYRLPNLTRKQYTAFIRKLFDDPSQSSELLSEAKKLNDSQAPK | 834 |
| Z16657 | VDAKYAKEIKQAQMEIYSLPNLTRKQYTAFIRKLLDDPSQSSELLSEAKKLNDSQAPK | 835 |
| Z16658 | VDAKYAKEVEEAQMEIYNLPNLTRRQYTAFIRKLLDDPSQSSELLSEAKKLNDSQAPK | 836 |
| Z16659 | VDAKYAKETEQAQMEIFGLPNLTRRQYTAFIRKLLDDPSQSSELLSEAKKLNDSQAPK | 837 |
| Z16660 | VDAKYAKEIEDAQMEIYYLPNLTRKQYTAFIRKLFDDPSQSSELLSEAKKLNDSQAPK | 838 |
| Z16661 | VDAKYAKESEQAYWEIYALPNLTRKQYTAFIRKLLDDPSQSSELLSEAKKLNDSQAPK | 839 |
| Z16662 | VDAKYAKEVEVAQMEIYDLPNLTRKQYTAFIRKLLDDPSQSSELLSEAKKLNDSQAPK | 840 |

FIGURE 1AD

| ID | Sequence | # |
|---|---|---|
| Z16663 | VDAKYAKEIERAQMEIFGLPNLTRKQYTAFIRKLLDDPSQSSELLSEAKKLNDSQAPK | 841 |
| Z16664 | VDAKYAKEAEQAQMEIFGLPNLTRKQYTAFIRKLFDDPSQSSELLSEAKKLNDSQAPK | 842 |
| Z16665 | VDAKYAKELEYAYFEIYNLPNLTRKQYTAFIRKLLDDPSQSSELLSEAKKLNDSQAPK | 843 |
| Z16666 | VDAKYAKEVEFAQMEIFALPNLTRKQYTAFIRKLLDDPSQSSELLSEAKKLNDSQAPK | 844 |
| Z16667 | VDAKYAKETEEAQMEIYNLPNLTRKQYTAFIRKLLDDPSQSSELLSEAKKLNDSQAPK | 845 |
| Z16668 | VDAKYAKETYNAQMEIFALPNLTRKQYTAFIRKLLDDPSQSSELLSEAKKLNDSQAPK | 846 |
| Z16669 | VDAKYAKEISVAQFEIYHLPNLTRKQYTAFIRKLFDDPSQSSELLSEAKKLNDSQAPK | 847 |
| Z16671 | VDAKYAKEIKAAQMEIFELPNLTRKQYTAFIRKLLDDPSQSSELLSEAKKLNDSQAPK | 848 |
| Z16672 | VDAKYAKEVEYAYQEIYALPNLTRKQYTAFIRKLLDDPSQSSELLSEAKKLNDSQAPK | 849 |
| Z16675 | VDAKYAKEVEIAQMEIFELPNLTRKQYTAFIRKLLDDPSQSSELLSEAKKLNDSQAPK | 850 |
| Z16676 | VDAKYAKEIDDAYLEIYALPNLTRKQYTAFIRKLLDDPSQSSELLSEAKKLNDSQAPK | 851 |
| Z16677 | VDAKYAKEAYIAQQEIFALPNLTRKQYTAFIRKLLDDPSQSSELLSEAKKLNDSQAPK | 852 |
| Z16678 | VDAKYAKEVEVAYFEIYALPNLTRKQYTAFIRKLLDDPSQSSELLSEAKKLNDSQAPK | 853 |
| Z16679 | VDAKYAKEVVTAQMEIFFLPNLTRKQYTAFIRKLLDDPSQSSELLSEAKKLNDSQAPK | 854 |
| Z16680 | VDAKYAKEVVIAQHEIFSLPNLTRRQYTAFIRKLLDDPSQSSELLSEAKKLNDSQAPK | 855 |
| Z16681 | VDAKYAKEVEYAYYEIFKLPNLTRKQYTAFIRKLLDDPSQSSELLSEAKKLNDSQAPK | 856 |
| Z16682 | VDAKYAKEAEAAQMEIFKLPNLTRKQYTAFIRKLLDDPSQSSELLSEAKKLNDSQAPK | 857 |
| Z16683 | VDAKYAKELEKAYYEIYELPNLTRKQYTAFIRKLLDDPSQSSELLSEAKKLNDSQAPK | 858 |
| Z16684 | VDAKYAKETHNAYQEIYQLPNLTRKQYTAFIRKLLDDPSQSSELLSEAKKLNDSQAPK | 859 |
| Z16685 | VDAKYAKEVIEAYEEIFALPNLTRKQYTAFIRKLLDDPSQSSELLSEAKKLNDSQAPK | 860 |
| Z16686 | VDAKYAKEVEAAYFEIFQLPNLTRKQYTAFIRKLLDDPSQSSELLSEAKKLNDSQAPK | 861 |
| Z16687 | VDAKYAKEAEDAYHEIFSLPNLTRKQYTAFIRKLLDDPSQSSELLSEAKKLNDSQAPK | 862 |
| Z16688 | VDAKYAKEVKDAQFEIFALPNLTRKQYTAFIRKLLDDPSQSSELLSEAKKLNDSQAPK | 863 |
| Z16689 | VDAKYAKEADFAYWEIYALPNLTRKQYTAFIRKLLDDPSQSSELLSEAKKLNDSQAPK | 864 |
| Z16690 | VDAKYAKEVQDAQMEIYYLPNLTRKQYTAFIRKLLDDPSQSSELLSEAKKLNDSQAPK | 865 |
| Z16691 | VDAKYAKEAVQAYHEIFALPNLTRKQYTAFIRKLLDDPSQSSELLSEAKKLNDSQAPK | 866 |
| Z16692 | VDAKYAKEATEAYDEIYLLPNLTRKQYTAFIRKLLDDPSQSSELLSEAKKLNDSQAPK | 867 |
| Z16693 | VDAKYAKEATEAYMEIYSLPNLTRKQYTAFIRKLLDDPSQSSELLSEAKKLNDSQAPK | 868 |
| Z16694 | VDAKYAKETESAYFEIYNLPNLTRKQYTAFIRKLLDDPSQSSELLSEAKKLNDSQAPK | 869 |

FIGURE 1AE

| ID | Sequence | # |
|---|---|---|
| Z16695 | VDAKYAKEAEKAYMEIFGLPNLTRKQYTAFIRKLLDDPSQSSELLSEAKKLNDSQAPK | 870 |
| Z16696 | VDAKYAKEVETAQMEIFSLPNLTRRQYTAFIRKLLDDPSQSSELLSEAKKLNDSQAPK | 871 |
| Z16697 | VDAKYAKELYSAQMEIYGLPNLTRKQYTAFIRKLFDDPSQSSELLSEAKKLNDSQAPK | 872 |
| Z16699 | VDAKYAKEAEEAYMEIFRLPNLTRKQYTAFIRKLLDDPSQSSELLSEAKKLNDSQAPK | 873 |
| Z16700 | VDAKYAKEAQEAYDEIYGLPNLTRKQYTAFIRKLLDDPSQSSELLSEAKKLNDSQAPK | 874 |
| Z16701 | VDAKYAKEHVEAYYEIYNLPNLTRRQYTAFIRKLLDDPSQSSELLSEAKKLNDSQAPK | 875 |
| Z16702 | VDAKYAKETEQAQMEIFKLPNLTRKQYTAFIRKLLDDPSQSSELLSEAKKLNDSQAPK | 876 |
| Z16703 | VDAKYAKEVEQAQMEIYNLPNLTRKQYTAFIRKLLDDPSQSSELLSEAKKLNDSQAPK | 877 |
| Z16704 | VDAKYAKEATSAYFEIYALPNLTRKQYTAFIRKLLDDPSQSSELLSEAKKLNDSQAPK | 878 |
| Z16705 | VDAKYAKELEAAQMEIFSLPNLTRKQYTAFIRKLLDDPSQSSELLSEAKKLNDSQAPK | 879 |
| Z16706 | VDAKYAKEAEDAYMEIYRLPNLTRKQYTAFIRKLLDDPSQSSELLSEAKKLNDSQAPK | 880 |
| Z16708 | VDAKYAKEAESAYMEIFRLPNLTRKQYTAFIRKLLDDPSQSSELLSEAKKLNDSQAPK | 881 |
| Z16709 | VDAKYAKELEAAYFEIYLPNLTRKQYTAFIRKLLDDPSQSSELLSEAKKLNDSQAPK | 882 |
| Z16710 | VDAKYAKEAEYAYFEIYNLPNLTRKQYTAFIRKLLDDPSQSSELLSEAKKLNDSQAPK | 883 |
| Z16711 | VDAKYAKETHSAQMEIFNLPNLTRKQYTAFIRKLLDDPSQSSELLSEAKKLNDSQAPK | 884 |
| Z16712 | VDAKYAKETERAQMEIFDLPNLTRKQYTAFIRKLLDDPSQSSELLSEAKKLNDSQAPK | 885 |
| Z16713 | VDAKYAKEAYSAQMEIFSLPNLTRKQYTAFIRKLLDDPSQSSELLSEAKKLNDSQAPK | 886 |
| Z16714 | VDAKYAKEIEDAQMEIFGLPNLTRKQYTAFIRKLFDDPSQSSELLSEAKKLNDSQAPK | 887 |
| Z16715 | VDAKYAKEVYSAQLEIFSLPNLTRKQYTAFIRKLFDDPSQSSELLSEAKKLNDSQAPK | 888 |
| Z16716 | VDAKYAKEVEQAYYEIFYLPNLTRKQYTAFIRKLLDDPSQSSELLSEAKKLNDSQAPK | 889 |
| Z16717 | VDAKYAKEIEEAYMEIFQLPNLTRKQYTAFIRKLLDDPSQSSELLSEAKKLNDSQAPK | 890 |
| Z16718 | VDAKYAKEIEKAQMEIFALPNLTRKQYTAFIRKLFDDPSQSSELLSEAKKLNDSQAPK | 891 |
| Z16719 | VDAKYAKEAVVAYSEIYGLPNLTRKQYTAFIRKLLDDPSQSSELLSEAKKLNDSQAPK | 892 |
| Z16720 | VDAKYAKEIEVAYSEIYNLPNLTRKQYTAFIRKLLDDPSQSSELLSEAKKLNDSQAPK | 893 |
| Z16721 | VDAKYAKEVDEAYMEIYELPNLTRKQYTAFIRKLLDDPSQSSELLSEAKKLNDSQAPK | 894 |
| Z16722 | VDAKYAKEIEHAQMEIFYLPNLTRKQYTAFIRKLFDDPSQSSELLSEAKKLNDSQAPK | 895 |
| Z16723 | VDAKYAKELSDAYFEIYALPNLTRKQYTAFIRKLLDDPSQSSELLSEAKKLNDSQAPK | 896 |
| Z16724 | VDAKYAKEVEEAQMEIFVLPNLTRKQYTAFIRKLLDDPSQSSELLSEAKKLNDSQAPK | 897 |
| Z16725 | VDAKYAKELEEAYMEIYHLPNLTRKQYTAFIRKLLDDPSQSSELLSEAKKLNDSQAPK | 898 |

FIGURE 1AF

| ID | Sequence | # |
|---|---|---|
| Z16726 | VDAKYAKEVELAYFEIFRLPNLTRKQYTAFIRKLLDDPSQSSELLSEAKKLNDSQAPK | 899 |
| Z16727 | VDAKYAKETVSAYWEIFELPNLTRKQYTAFIRKLLDDPSQSSELLSEAKKLNDSQAPK | 900 |
| Z16728 | VDAKYAKEIKEAQMEIYYLPNLTRKQYTAFIRKLLDDPSQSSELLSEAKKLNDSQAPK | 901 |
| Z16729 | VDAKYAKELEEAQMEIFKLPNLTRKQYTAFIRKLLDDPSQSSELLSEAKKLNDSQAPK | 902 |
| Z16730 | VDAKYAKEIEDAYMEIYRLPNLTRKQYTAFIRKLLDDPSQSSELLSEAKKLNDSQAPK | 903 |
| Z16731 | VDAKYAKEVEIAYFEIYNLPNLTRKQYTAFIRKLLDDPSQSSELLSEAKKLNDSQAPK | 904 |
| Z16732 | VDAKYAKEAESAYWEIYALPNLTRKQYTAFIRKLLDDPSQSSELLSEAKKLNDSQAPK | 905 |
| Z16733 | VDAKYAKEVEAAYMEIYHLPNLTRKQYTAFIRKLLDDPSQSSELLSEAKKLNDSQAPK | 906 |
| Z16734 | VDAKYAKEAVDAYWEIYGLPNLTRKQYTAFIRKLLDDPSQSSELLSEAKKLNDSQAPK | 907 |
| Z16735 | VDAKYAKEVEIAYFEIYALPNLTRKQYTAFIRKLLDDPSQSSELLSEAKKLNDSQAPK | 908 |
| Z16736 | VDAKYAKEVINAYFEIYHLPNLTRKQYTAFIRKLLDDPSQSSELLSEAKKLNDSQAPK | 909 |
| Z16737 | VDAKYAKEVEEAYMEIFQLPNLTRKQYTAFIRKLLDDPSQSSELLSEAKKLNDSQAPK | 910 |
| Z16738 | VDAKYAKEVEAAYFEIYDLPNLTRKQYTAFIRKLLDDPSQSSELLSEAKKLNDSQAPK | 911 |
| Z16739 | VDAKYAKEVEDAYFEIYHLPNLTRKQYTAFIRKLLDDPSQSSELLSEAKKLNDSQAPK | 912 |
| Z16740 | VDAKYAKEIEDAYMEIYYLPNLTRKQYTAFIRKLLDDPSQSSELLSEAKKLNDSQAPK | 913 |
| Z16741 | VDAKYAKEVEDAQMEIFNLPNLTRKQYTAFIRKLLDDPSQSSELLSEAKKLNDSQAPK | 914 |
| Z16742 | VDAKYAKEVEDAYMEIFHLPNLTRKQYTAFIRKLLDDPSQSSELLSEAKKLNDSQAPK | 915 |
| Z16743 | VDAKYAKEQESAYWEIYALPNLTRKQYTAFIRKLLDDPSQSSELLSEAKKLNDSQAPK | 916 |
| Z16745 | VDAKYAKETEEAYQEIYQLPNLTRKQYTAFIRKLLDDPSQSSELLSEAKKLNDSQAPK | 917 |
| Z16746 | VDAKYAKEELEAYWEIFALPNLTRKQYTAFIRKLLDDPSQSSELLSEAKKLNDSQAPK | 918 |
| Z16747 | VDAKYAKEVQDAYWEIYALPNLTRKQYTAFIRKLLDDPSQSSELLSEAKKLNDSQAPK | 919 |
| Z16748 | VDAKYAKEVENAYFEIFALPNLTRKQYTAFIRKLLDDPSQSSELLSEAKKLNDSQAPK | 920 |
| Z16749 | VDAKYAKEVEAAYYEIYGLPNLTRKQYTAFIRKLLDDPSQSSELLSEAKKLNDSQAPK | 921 |
| Z16750 | VDAKYAKEVEHAYFEIYHLPNLTRKQYTAFIRKLLDDPSQSSELLSEAKKLNDSQAPK | 922 |
| Z16751 | VDAKYAKEVHEAYMEIFELPNLTRKQYTAFIRKLLDDPSQSSELLSEAKKLNDSQAPK | 923 |
| Z16752 | VDAKYAKEVEQAYMEIYALPNLTRKQYTAFIRKLLDDPSQSSELLSEAKKLNDSQAPK | 924 |
| Z16753 | VDAKYAKEVVDAYYEIYDLPNLTRKQYTAFIRKLLDDPSQSSELLSEAKKLNDSQAPK | 925 |
| Z16754 | VDAKYAKEAQIAYFEIYSLPNLTRKQYTAFIRKLLDDPSQSSELLSEAKKLNDSQAPK | 926 |
| Z16755 | VDAKYAKEVEFAYYEIYRLPNLTRKQYTAFIRKLLDDPSQSSELLSEAKKLNDSQAPK | 927 |

FIGURE 1AG

| | | |
|---|---|---|
| Z16756 | VDAKYAKEVVEAYYEEIYDLPNLTRKQYTAFIRKLLDDPSQSSELLSEAKKLNDSQAPK | 928 |
| Z16757 | VDAKYAKEIEEAYMEIYELPNLTRKQYTAFIRKLLDDPSQSSELLSEAKKLNDSQAPK | 929 |
| Z16758 | VDAKYAKEVQTAYMEIYHLPNLTRKQYTAFIRKLLDDPSQSSELLSEAKKLNDSQAPK | 930 |
| Z16759 | VDAKYAKEAEYAYFEIYKLPNLTRKQYTAFIRKLLDDPSQSSELLSEAKKLNDSQAPK | 931 |
| Z16760 | VDAKYAKEAYIAQMEIFELPNLTRKQYTAFIRKLLDDPSQSSELLSEAKKLNDSQAPK | 932 |
| Z16761 | VDAKYAKEAERAYWEIYELPNLTRKQYTAFIRKLLDDPSQSSELLSEAKKLNDSQAPK | 933 |
| Z16762 | VDAKYAKETHDAYYEIYGLPNLTRKQYTAFIRKLLDDPSQSSELLSEAKKLNDSQAPK | 934 |
| Z16763 | VDAKYAKELEDAYYEIFGLPNLTRKQYTAFIRKLLDDPSQSSELLSEAKKLNDSQAPK | 935 |
| Z16764 | VDAKYAKEVEDAYQEIFQLPNLTRKQYTAFIRKLLDDPSQSSELLSEAKKLNDSQAPK | 936 |
| Z16765 | VDAKYAKEAHNAYYEIYALPNLTRKQYTAFIRKLLDDPSQSSELLSEAKKLNDSQAPK | 937 |
| Z16766 | VDAKYAKEVEDAYFETYWLPNLTRKQYTAFIRKLLDDPSQSSELLSEAKKLNDSQAPK | 938 |
| Z16767 | VDAKYAKEVTEAYFEIYRLPNLTRKQYTAFIRKLLDDPSQSSELLSEAKKLNDSQAPK | 939 |
| Z16768 | VDAKYAKEVEKAYEEIYKLPNLTRKQYTAFIRKLLDDPSQSSELLSEAKKLNDSQAPK | 940 |
| Z16769 | VDAKYAKEVDYAYFEIYKLPNLTRKQYTAFIRKLLDDPSQSSELLSEAKKLNDSQAPK | 941 |
| Z16770 | VDAKYAKETEAAYFEIFHLPNLTRKQYTAFIRKLLDDPSQSSELLSEAKKLNDSQAPK | 942 |
| Z16771 | VDAKYAKEVEVAYMEIFQLPNLTRKQYTAFIRKLLDDPSQSSELLSEAKKLNDSQAPK | 943 |
| Z16772 | VDAKYAKEVEQAYMEIFGLPNLTRKQYTAFIRKLLDDPSQSSELLSEAKKLNDSQAPK | 944 |
| Z16773 | VDAKYAKEVEYEYAYFEIYGLPNLTRKQYTAFIRKLLDDPSQSSELLSEAKKLNDSQAPK | 945 |
| Z16774 | VDAKYAKEAEVAYWEIYALPNLTRKQYTAFIRKLLDDPSQSSELLSEAKKLNDSQAPK | 946 |
| Z16775 | VDAKYAKEVELAYYEIYRLPNLTRKQYTAFIRKLLDDPSQSSELLSEAKKLNDSQAPK | 947 |
| Z16776 | VDAKYAKEVIQAYFEIYELPNLTRKQYTAFIRKLLDDPSQSSELLSEAKKLNDSQAPK | 948 |
| Z16777 | VDAKYAKEAEDAYWEIFKLPNLTRKQYTAFIRKLLDDPSQSSELLSEAKKLNDSQAPK | 949 |
| Z16778 | VDAKYAKEVTEAYFEIYALPNLTRKQYTAFIRKLLDDPSQSSELLSEAKKLNDSQAPK | 950 |
| Z16779 | VDAKYAKEVEAYFEIYRLPNLTRKQYTAFIRKLLDDPSQSSELLSEAKKLNDSQAPK | 951 |
| Z16780 | VDAKYAKEVQEAYFEIFGLPNLTRKQYTAFIRKLLDDPSQSSELLSEAKKLNDSQAPK | 952 |
| Z16781 | VDAKYAKEVVEAYEEIYALPNLTRKQYTAFIRKLLDDPSQSSELLSEAKKLNDSQAPK | 953 |
| Z16782 | VDAKYAKEVQVAYFEIFALPNLTRKQYTAFIRKLLDDPSQSSELLSEAKKLNDSQAPK | 954 |
| Z16783 | VDAKYAKEVEDAYIEIYELPNLTRKQYTAFIRKLLDDPSQSSELLSEAKKLNDSQAPK | 955 |
| Z16784 | VDAKYAKEVEAAYYEIYELPNLTRKQYTAFIRKLLDDPSQSSELLSEAKKLNDSQAPK | 956 |

FIGURE 1AH

| | | |
|---|---|---|
| Z16785 | VDAKYAKEVEIAYDEIYRLPNLTRKQYTAFIRKLLDDPSQSSELLSEAKKLNDSQAPK | 957 |
| Z16786 | VDAKYAKEHEEAYWEIYALPNLTRKQYTAFIRKLLDDPSQSSELLSEAKKLNDSQAPK | 958 |
| Z16787 | VDAKYAKEVLAQMEIFSLPNLTRKQYTAFIRKLLDDPSQSSELLSEAKKLNDSQAPK | 959 |
| Z16788 | VDAKYAKETEKAQMEIFQLPNLTRKQYTAFIRKLLDDPSQSSELLSEAKKLNDSQAPK | 960 |
| Z16789 | VDAKYAKELEEAYMEIYALPNLTRKQYTAFIRKLLDDPSQSSELLSEAKKLNDSQAPK | 961 |
| Z16790 | VDAKYAKEVYEAYDEIYNLPNLTRKQYTAFIRKLLDDPSQSSELLSEAKKLNDSQAPK | 962 |
| Z16791 | VDAKYAKETIEAYEEIYELPNLTRKQYTAFIRKLLDDPSQSSELLSEAKKLNDSQAPK | 963 |
| Z16792 | VDAKYAKEHIEAYDEIFKLPNLTRKQYTAFIRKLLDDPSQSSELLSEAKKLNDSQAPK | 964 |
| Z16793 | VDAKYAKEAQLAYWEIYGLPNLTRKQYTAFIRKLLDDPSQSSELLSEAKKLNDSQAPK | 965 |
| Z16794 | VDAKYAKEVFDAQMEIFSLPNLTRKQYTAFIRKLLDDPSQSSELLSEAKKLNDSQAPK | 966 |
| Z16795 | VDAKYAKEIEEAQMEIYYLPNLTRKQYTAFIRKLLDDPSQSSELLSEAKKLNDSQAPK | 967 |
| Z16796 | VDAKYAKEVEKAYFEIFKLPNLTRKQYTAFIRKLLDDPSQSSELLSEAKKLNDSQAPK | 968 |
| Z16797 | VDAKYAKEVEVAYYEIYGLPNLTRKQYTAFIRKLLDDPSQSSELLSEAKKLNDSQAPK | 969 |
| Z16798 | VDAKYAKEVEYAYFEIYNLPNLTRKQYTAFIRKLLDDPSQSSELLSEAKKLNDSQAPK | 970 |
| Z16799 | VDAKYAKEVIAAYYEIYELPNLTRKQYTAFIRKLLDDPSQSSELLSEAKKLNDSQAPK | 971 |
| Z16800 | VDAKYAKEVVDAYMEIYGLPNLTRKQYTAFIRKLLDDPSQSSELLSEAKKLNDSQAPK | 972 |
| Z16801 | VDAKYAKEAETAYFEIYALPNLTRKQYTAFIRKLLDDPSQSSELLSEAKKLNDSQAPK | 973 |
| Z16802 | VDAKYAKEVEEAQMEIYRLPNLTRKQYTAFIRKLLDDPSQSSELLSEAKKLNDSQAPK | 974 |
| Z16803 | VDAKYAKEAEAAYFEIFALPNLTRKQYTAFIRKLLDDPSQSSELLSEAKKLNDSQAPK | 975 |
| Z16804 | VDAKYAKEVEAAQMEIFDLPNLTRRQYTAFIRKLLDDPSQSSELLSEAKKLNDSQAPK | 976 |
| Z16805 | VDAKYAKELEWAYFETYALPNLTRKQYTAFIRKLLDDPSQSSELLSEAKKLNDSQAPK | 977 |
| Z16806 | VDAKYAKEQKQAYWEIYALPNLTRKQYTAFIRKLLDDPSQSSELLSEAKKLNDSQAPK | 978 |
| Z16808 | VDAKYAKEAEDAYYEIYALPNLTRKQYTAFIRKLLDDPSQSSELLSEAKKLNDSQAPK | 979 |
| Z16809 | VDAKYAKEQHEAYWEIYRLPNLTRKQYTAFIRKLLDDPSQSSELLSEAKKLNDSQAPK | 980 |
| Z16810 | VDAKYAKEVEDAYMEIFGLPNLTRKQYTAFIRKLLDDPSQSSELLSEAKKLNDSQAPK | 981 |
| Z16811 | VDAKYAKEVDHAYFEIYRLPNLTRKQYTAFIRKLLDDPSQSSELLSEAKKLNDSQAPK | 982 |
| Z16812 | VDAKYAKEAIEAYDEIFLLPNLTRKQYTAFIRKLLDDPSQSSELLSEAKKLNDSQAPK | 983 |
| Z16813 | VDAKYAKEVVEAYWEIYALPNLTRKQYTAFIRKLLDDPSQSSELLSEAKKLNDSQAPK | 984 |
| Z16814 | VDAKYAKETEDAQMEIFSLPNLTRKQYTAFIRKLLDDPSQSSELLSEAKKLNDSQAPK | 985 |

FIGURE 1AI

| | | |
|---|---|---|
| Z16815 | VDAKYAKEVIDAYYEIYELPNLTRKQYTAFIRKLLDDPSQSSELLSEAKKLNDSQAPK | 986 |
| Z16816 | VDAKYAKEAIDAYHEIFALPNLTRKQYTAFIRKLLDDPSQSSELLSEAKKLNDSQAPK | 987 |
| Z16817 | VDAKYAKETHDAYMEIYHLPNLTRKQYTAFIRKLLDDPSQSSELLSEAKKLNDSQAPK | 988 |
| Z16818 | VDAKYAKEIESAYMEIFYLPNLTRKQYTAFIRKLLDDPSQSSELLSEAKKLNDSQAPK | 989 |
| Z16819 | VDAKYAKEIEKAYMEIYHLPNLTRRQYTAFIRKLLDDPSQSSELLSEAKKLNDSQAPK | 990 |
| Z16820 | VDAKYAKEAEDAYQEIFQLPNLTRKQYTAFIRKLLDDPSQSSELLSEAKKLNDSQAPK | 991 |
| Z16821 | VDAKYAKEVEEAYMEIFALPNLTRKQYTAFIRKLLDDPSQSSELLSEAKKLNDSQAPK | 992 |
| Z16822 | VDAKYAKEVEDAQMEIFELPNLTRKQYTAFIRKLLDDPSQSSELLSEAKKLNDSQAPK | 993 |
| Z16823 | VDAKYAKEVENAQYEIYGLPNLTRKQYTAFIRKLLDDPSQSSELLSEAKKLNDSQAPK | 994 |
| Z16824 | VDAKYAKEVEVAYMEIYALPNLTRKQYTAFIRKLLDDPSQSSELLSEAKKLNDSQAPK | 995 |
| Z16825 | VDAKYAKESEQAYWEIFHLPNLTRKQYTAFIRKLLDDPSQSSELLSEAKKLNDSQAPK | 996 |
| Z16826 | VDAKYAKETVDAYEEIFTLPNLTRKQYTAFIRKLLDDPSQSSELLSEAKKLNDSQAPK | 997 |
| Z16827 | VDAKYAKEIEEAYMEIYHLPNLTRKQYTAFIRKLLDDPSQSSELLSEAKKLNDSQAPK | 998 |
| Z16829 | VDAKYAKEVVVAYEEIFKLPNLTRKQYTAFIRKLLDDPSQSSELLSEAKKLNDSQAPK | 999 |
| Z16830 | VDAKYAKEAVNAYWEIYALPNLTRKQYTAFIRKLLDDPSQSSELLSEAKKLNDSQAPK | 1000 |
| Z16831 | VDAKYAKESEKAYMEIFALPNLTRKQYTAFIRKLLDDPSQSSELLSEAKKLNDSQAPK | 1001 |
| Z16832 | VDAKYAKEVEEAYFEIYLLPNLTRKQYTAFIRKLLDDPSQSSELLSEAKKLNDSQAPK | 1002 |
| Z16833 | VDAKYAKEIEAAQMEIFGLPNLTRKQYTAFIRKLLDDPSQSSELLSEAKKLNDSQAPK | 1003 |
| Z16834 | VDAKYAKEQEKAYFEIYALPNLTRKQYTAFIRKLLDDPSQSSELLSEAKKLNDSQAPK | 1004 |
| Z16835 | VDAKYAKEVEIAYYEIFALPNLTRRQYTAFIRKLLDDPSQSSELLSEAKKLNDSQAPK | 1005 |
| Z16836 | VDAKYAKEVYAAYFEIFGLPNLTRKQYTAFIRKLLDDPSQSSELLSEAKKLNDSQAPK | 1006 |
| Z16837 | VDAKYAKEVESAQMEIFGLPNLTRKQYTAFIRKLLDDPSQSSELLSEAKKLNDSQAPK | 1007 |
| Z16838 | VDAKYAKELEVAYMEIYELPNLTRKQYTAFIRKLLDDPSQSSELLSEAKKLNDSQAPK | 1008 |
| Z16839 | VDAKYAKETINAYWEIYALPNLTRKQYTAFIRKLLDDPSQSSELLSEAKKLNDSQAPK | 1009 |
| Z16840 | VDAKYAKEAETAYWEIYKLPNLTRKQYTAFIRKLLDDPSQSSELLSEAKKLNDSQAPK | 1010 |
| Z16852 | VDAKYAKETEAAYWEIFALPNLTRKQYTAFIRKLLDDPSQSSELLSEAKKLNDSQAPK | 1011 |
| Z16853 | VDAKYAKELQKAYMEIYELPNLTRKQYTAFIRKLLDDPSQSSELLSEAKKLNDSQAPK | 1012 |
| Z16854 | VDAKYAKELEVAYFEIYDLPNLTRKQYTAFIRKLLDDPSQSSELLSEAKKLNDSQAPK | 1013 |
| Z16855 | VDAKYAKEVEYAYWEIFALPNLTRKQYTAFIRKLLDDPSQSSELLSEAKKLNDSQAPK | 1014 |

FIGURE 1AJ

| | | |
|---|---|---|
| Z16856 | VDAKYAKETEEAYFEIYGLPNLTRKQYTAFIRKLLDDPSQSSELLSEAKKLNDSQAPK | 1015 |
| Z16857 | VDAKYAKELESAYMEIYGLPNLTRKQYTAFIRKLLDDPSQSSELLSEAKKLNDSQAPK | 1016 |
| Z16858 | VDAKYAKEVEVAYMEIFGLPNLTRKQYTAFIRKLLDDPSQSSELLSEAKKLNDSQAPK | 1017 |
| Z16859 | VDAKYAKEVEDAYMEIYELPNLTRKQYTAFIRKLLDDPSQSSELLSEAKKLNDSQAPK | 1018 |
| Z16860 | VDAKYAKEHVDAYYEIYGLPNLTRKQYTAFIRKLLDDPSQSSELLSEAKKLNDSQAPK | 1019 |
| Z16861 | VDAKYAKEHERAYFEIYALPNLTRKQYTAFIRKLLDDPSQSSELLSEAKKLNDSQAPK | 1020 |
| Z16862 | VDAKYAKEATEAYWEIYALPNLTRKQYTAFIRKLLDDPSQSSELLSEAKKLNDSQAPK | 1021 |
| Z16863 | VDAKYAKEVYKAQMEIFGLPNLTRKQYTAFIRKLLDDPSQSSELLSEAKKLNDSQAPK | 1022 |
| Z16864 | VDAKYAKEVERAYMEIFRLPNLTRKQYTAFIRKLLDDPSQSSELLSEAKKLNDSQAPK | 1023 |
| Z16865 | VDAKYAKELEHAQLEIFRLPNLTRKQYTAFIRKLLDDPSQSSELLSEAKKLNDSQAPK | 1024 |
| Z16866 | VDAKYAKEAQAAYDEIYGLPNLTRKQYTAFIRKLLDDPSQSSELLSEAKKLNDSQAPK | 1025 |
| Z16867 | VDAKYAKEVEEAQMEIYELPNLTRKQYTAFIRKLLDDPSQSSELLSEAKKLNDSQAPK | 1026 |
| Z16868 | VDAKYAKEVEEAYMEIFHLPNLTRKQYTAFIRKLLDDPSQSSELLSEAKKLNDSQAPK | 1027 |
| Z16869 | VDAKYAKEVEHAYFEIYGLPNLTRKQYTAFIRKLLDDPSQSSELLSEAKKLNDSQAPK | 1028 |
| Z16870 | VDAKYAKEVESAQMEIYYLPNLTRKQYTAFIRKLLDDPSQSSELLSEAKKLNDSQAPK | 1029 |
| Z16871 | VDAKYAKEVEKAQMEIFYLPNLTRKQYTAFIRKLLDDPSQSSELLSEAKKLNDSQAPK | 1030 |
| Z16873 | VDAKYAKEVEDAYMEIFKLPNLTRKQYTAFIRKLLDDPSQSSELLSEAKKLNDSQAPK | 1031 |
| Z16874 | VDAKYAKETEEAYMEIYHLPNLTRKQYTAFIRKLLDDPSQSSELLSEAKKLNDSQAPK | 1032 |
| Z16875 | VDAKYAKEAEAAYFEIYGLPNLTRKQYTAFIRKLLDDPSQSSELLSEAKKLNDSQAPK | 1033 |
| Z16876 | VDAKYAKELEDAYMEIYHLPNLTRKQYTAFIRKLLDDPSQSSELLSEAKKLNDSQAPK | 1034 |
| Z16877 | VDAKYAKEVEVAVEAYWEIYELPNLTRKQYTAFIRKLLDDPSQSSELLSEAKKLNDSQAPK | 1035 |
| Z16878 | VDAKYAKELEEAYMEIYGLPNLTRKQYTAFIRKLLDDPSQSSELLSEAKKLNDSQAPK | 1036 |
| Z16879 | VDAKYAKEVENAYMEIYELPNLTRKQYTAFIRKLLDDPSQSSELLSEAKKLNDSQAPK | 1037 |
| Z16880 | VDAKYAKEVENAYMEIYELPNLTRKQYTAFIRKLLDDPSQSSELLSEAKKLNDSQAPK | 1038 |
| Z16881 | VDAKYAKETVKAYEEIYKLPNLTRKQYTAFIRKLLDDPSQSSELLSEAKKLNDSQAPK | 1039 |
| Z16882 | VDAKYAKELEKAQMEIFSLPNLTRKQYTAFIRKLLDDPSQSSELLSEAKKLNDSQAPK | 1040 |
| Z16883 | VDAKYAKETEKAQLEIFELPNLTRKQYTAFIRKLLDDPSQSSELLSEAKKLNDSQAPK | 1041 |
| Z16884 | VDAKYAKEVELAYMEIFHLPNLTRKQYTAFIRKLLDDPSQSSELLSEAKKLNDSQAPK | 1042 |
| Z16886 | VDAKYAKEAENAYWEIYELPNLTRRQYTAFIRKLLDDPSQSSELLSEAKKLNDSQAPK | 1043 |

FIGURE 1AK

| | | |
|---|---|---|
| Z16887 | VDAKYAKEVIQAYWEIYHLPNLTRKQYTAFIRKLLDDPSQSSELLSEAKKLNDSQAPK | 1044 |
| Z16888 | VDAKYAKEAEYAYMEIFRLPNLTRKQYTAFIRKLLDDPSQSSELLSEAKKLNDSQAPK | 1045 |
| Z16889 | VDAKYAKEVESAYMEIYHLPNLTRKQYTAFIRKLLDDPSQSSELLSEAKKLNDSQAPK | 1046 |
| Z16890 | VDAKYAKETEDAYMEIFRLPNLTRKQYTAFIRKLLDDPSQSSELLSEAKKLNDSQAPK | 1047 |
| Z16891 | VDAKYAKEVDAAYFEIFNLPNLTRKQYTAFIRKLLDDPSQSSELLSEAKKLNDSQAPK | 1048 |
| Z16892 | VDAKYAKEAEDAYFEIYSLPNLTRKQYTAFIRKLLDDPSQSSELLSEAKKLNDSQAPK | 1049 |
| Z16893 | VDAKYAKELEDAYMEIFGLPNLTRKQYTAFIRKLLDDPSQSSELLSEAKKLNDSQAPK | 1050 |
| Z16894 | VDAKYAKEVEAAYFEIYGLPNLTRKQYTAFIRKLLDDPSQSSELLSEAKKLNDSQAPK | 1051 |
| Z16895 | VDAKYAKEVEFAYYEIFALPNLTRKQYTAFIRKLLDDPSQSSELLSEAKKLNDSQAPK | 1052 |
| Z16896 | VDAKYAKEVVSAYWEIYALPNLTRRQYTAFIRKLLDDPSQSSELLSEAKKLNDSQAPK | 1053 |
| Z16897 | VDAKYAKETEKAYFEIYALPNLTRKQYTAFIRKLLDDPSQSSELLSEAKKLNDSQAPK | 1054 |
| Z16898 | VDAKYAKEAEYAYMEIYNLPNLTRKQYTAFIRKLLDDPSQSSELLSEAKKLNDSQAPK | 1055 |
| Z16899 | VDAKYAKEVESAYMEIYRLPNLTRKQYTAFIRKLLDDPSQSSELLSEAKKLNDSQAPK | 1056 |
| Z16900 | VDAKYAKEVEVAYMEIYGLPNLTRKQYTAFIRKLLDDPSQSSELLSEAKKLNDSQAPK | 1057 |
| Z16901 | VDAKYAKEIEFAYMEIFHLPNLTRKQYTAFIRKLLDDPSQSSELLSEAKKLNDSQAPK | 1058 |
| Z16902 | VDAKYAKEVVEAYFEIYELPNLTRKQYTAFIRKLLDDPSQSSELLSEAKKLNDSQAPK | 1059 |
| Z16903 | VDAKYAKEIEAAQMEIFALPNLTRKQYTAFIRKLFDDPSQSSELLSEAKKLNDSQAPK | 1060 |
| Z16904 | VDAKYAKEVEDAQMEIFGLPNLTRKQYTAFIRKLFDDPSQSSELLSEAKKLNDSQAPK | 1061 |
| Z16905 | VDAKYAKEIEEAQMEIYGLPNLTRKQYTAFIRKLFDDPSQSSELLSEAKKLNDSQAPK | 1062 |
| Z16906 | VDAKYAKETLDAQMEIFALPNLTRKQYTAFIRKLLDDPSQSSELLSEAKKLNDSQAPK | 1063 |
| Z16907 | VDAKYAKETQEAQMEIFALPNLTRRQYTAFIRKLLDDPSQSSELLSEAKKLNDSQAPK | 1064 |
| Z16908 | VDAKYAKEVEEAQMEIFALPNLTRKQYTAFIRKLLDDPSQSSELLSEAKKLNDSQAPK | 1065 |
| Z16909 | VDAKYAKEVEDAQMEIFALPNLTRKQYTAFIRKLFDDPSQSSELLSEAKKLNDSQAPK | 1066 |
| Z16910 | VDAKYAKEVESAQMEIFYLPNLTRKQYTAFIRKLFDDPSQSSELLSEAKKLNDSQAPK | 1067 |
| Z16911 | VDAKYAKEIEDAQMEIFALPNLTRKQYTAFIRKLLDDPSQSSELLSEAKKLNDSQAPK | 1068 |
| Z16912 | VDAKYAKEVEAAQMEIFFLPNLTRRQYTAFIRKLLDDPSQSSELLSEAKKLNDSQAPK | 1069 |
| Z16913 | VDAKYAKEVEEAQLEIFALPNLTRKQYTAFIIKLFDDPSQSSELLSEAKKLNDSQAPK | 1070 |
| Z16914 | VDAKYAKETEDAQMEIFALPNLTRKQYTAFIRKLFDDPSQSSELLSEAKKLNDSQAPK | 1071 |
| Z16915 | VDAKYAKEIEIAQMEIFRLPNLTRKQYTAFIRKLFDDPSQSSELLSEAKKLNDSQAPK | 1072 |

FIGURE 1AL

| | | |
|---|---|---|
| Z16916 | VDAKYAKEVEIAQMEIFALPNLTRKQYTAFIRKLFDDPSQSSELLSEAKKLNDSQAPK | 1073 |
| Z16917 | VDAKYAKEIEIAQMEIFSLPNLTRKQYTAFIRKLFDDPSQSSELLSEAKKLNDSQAPK | 1074 |
| Z16918 | VDAKYAKETEAAQMEIFYLPNLTRKQYTAFIRKLLDDPSQSSELLSEAKKLNDSQAPK | 1075 |
| Z17171 | VDAKYAKEIEDAQMEIFALPNLTRKQYTAFIRKLFDDPSQSSELLSEAKKLNDSQAPK | 1076 |
| Z17173 | VDAKYAKEVEHAQMEIFDLPNLTRKQYTAFIRKLLDDPSQSSELLSEAKKLNDSQAPK | 1077 |
| Z17174 | VDAKYAKEVVSAQMEIFGLPNLTRKQYTAFIRKLLDDPSQSSELLSEAKKLNDSQAPK | 1078 |
| Z17175 | VDAKYAKELDEAYFEIYGLPNLTRRQYTAFIRKLLDDPSQSSELLSEAKKLNDSQAPK | 1079 |
| Z17176 | VDAKYAKEVEHAQLEIFRLPNLTRKQYTAFIRKLLDDPSQSSELLSEAKKLNDSQAPK | 1080 |
| Z17177 | VDAKYAKEAYKAQMEIFGLPNLTRKQYTAFIRKLLDDPSQSSELLSEAKKLNDSQAPK | 1081 |
| Z17178 | VDAKYAKEIELAQMEIFFLPNLTRKQYTAFIRKLLDDPSQSSELLSEAKKLNDSQAPK | 1082 |
| Z17179 | VDAKYAKEVEHAQMEIFTLPNLTRKQYTAFIRKLLDDPSQSSELLSEAKKLNDSQAPK | 1083 |
| Z17180 | VDAKYAKEVKIAQMEIYELPNLTRKQYTAFIRKLLDDPSQSSELLSEAKKLNDSQAPK | 1084 |
| Z17181 | VDAKYAKEAEDAYQEIFGLPNLTRKQYTAFIRKLLDDPSQSSELLSEAKKLNDSQAPK | 1085 |
| Z17182 | VDAKYAKEAENAYDEIYKLPNLTRKQYTAFIRKLLDDPSQSSELLSEAKKLNDSQAPK | 1086 |
| Z17183 | VDAKYAKEIEAAQIEIFHLPNLTRKQYTAFIRKLLDDPSQSSELLSEAKKLNDSQAPK | 1087 |
| Z17184 | VDAKYAKEVVDAQQEIFNLPNLTRKQYTAFIRKLFDDPSQSSELLSEAKKLNDSQAPK | 1088 |
| Z17185 | VDAKYAKEIEWAQMEIFALPNLTRKQYTAFIRKLFDDPSQSSELLSEAKKLNDSQAPK | 1089 |
| Z17186 | VDAKYAKEIEDAQMEIYELPNLTRKQYTAFIRKLLDDPSQSSELLSEAKKLNDSQAPK | 1090 |
| Z17187 | VDAKYAKEAEKAQIEIFYLPNLTRKQYTAFIRKLFDDPSQSSELLSEAKKLNDSQAPK | 1091 |
| Z17188 | VDAKYAKEAEWAQMEIYSLPNLTRKQYTAFIRKLFDDPSQSSELLSEAKKLNDSQAPK | 1092 |
| Z17189 | VDAKYAKEAAYMEIFQLPNLTRKQYTAFIRKLFDDPSQSSELLSEAKKLNDSQAPK | 1093 |
| Z17190 | VDAKYAKEVEIAQMEIYSLPNLTRRQYTAFIRKLLDDPSQSSELLSEAKKLNDSQAPK | 1094 |
| Z17191 | VDAKYAKEIKAAQMEIFNLPNLTRKQYTAFIRKLLDDPSQSSELLSEAKKLNDSQAPK | 1095 |
| Z17192 | VDAKYAKEVEYAQMEIFHLPNLTRKQYTAFIRKLFDDPSQSSELLSEAKKLNDSQAPK | 1096 |
| Z17193 | VDAKYAKEVYAAQQEIFHLPNLTRKQYTAFIRKLFDDPSQSSELLSEAKKLNDSQAPK | 1097 |
| Z17194 | VDAKYAKEAEQAYMEIFRLPNLTRKQYTAFIRKLLDDPSQSSELLSEAKKLNDSQAPK | 1098 |
| Z17195 | VDAKYAKEVDVAYQEIFNLPNLTRKQYTAFIRKLLDDPSQSSELLSEAKKLNDSQAPK | 1099 |
| Z17196 | VDAKYAKEVYHAQMEIFSLPNLTRKQYTAFIRKLFDDPSQSSELLSEAKKLNDSQAPK | 1100 |
| Z17197 | VDAKYAKEAEDAQMEIYALPNLTRKQYTAFIRKLLDDPSQSSELLSEAKKLNDSQAPK | 1101 |

FIGURE 1AM

| | | |
|---|---|---|
| Z17198 | VDAKYAKEVQEAQMEIFELPNLTRKQYTAFIRKLLDDPSQSSELLSEAKKLNDSQAPK | 1102 |
| Z17199 | VDAKYAKEHEFAYMEIYHLPNLTRKQYTAFIRKLLDDPSQSSELLSEAKKLNDSQAPK | 1103 |
| Z17200 | VDAKYAKEAEEAYVEIFKLPNLTRKQYTAFIRKLLDDPSQSSELLSEAKKLNDSQAPK | 1104 |
| Z17201 | VDAKYAKELEKAQFEIYYLPNLTRKQYTAFIRKLLDDPSQSSELLSEAKKLNDSQAPK | 1105 |
| Z17202 | VDAKYAKEVYKAQMEIFALPNLTRKQYTAFIRKLFDDPSQSSELLSEAKKLNDSQAPK | 1106 |
| Z17203 | VDAKYAKEVEKAQMEIYYLPNLTRKQYTAFIRKLLDDPSQSSELLSEAKKLNDSQAPK | 1107 |
| Z17204 | VDAKYAKEVEAAQLEIFELPNLTRKQYTAFIRKLLDDPSQSSELLSEAKKLNDSQAPK | 1108 |
| Z17205 | VDAKYAKETYQAQMEIYSLPNLTRKQYTAFIRKLLDDPSQSSELLSEAKKLNDSQAPK | 1109 |
| Z17206 | VDAKYAKELEDAYQEIFHLPNLTRKQYTAFIRKLLDDPSQSSELLSEAKKLNDSQAPK | 1110 |
| Z17207 | VDAKYAKEVEEAQLEIFSLPNLTRKQYTAFIRKLLDDPSQSSELLSEAKKLNDSQAPK | 1111 |
| Z17208 | VDAKYAKEIYLAQMEIFKLPNLTRKQYTAFIRKLLDDPSQSSELLSEAKKLNDSQAPK | 1112 |
| Z17209 | VDAKYAKEIEEAQMEIEEAQMEIFKLPNLTRRQYTAFIRKLLDDPSQSSELLSEAKKLNDSQAPK | 1113 |
| Z17210 | VDAKYAKETEQAYMEIYQLPNLTRKQYTAFIRKLLDDPSQSSELLSEAKKLNDSQAPK | 1114 |
| Z17211 | VDAKYAKEAEAAYYEIYHLPNLTRKQYTAFIRKLLDDPSQSSELLSEAKKLNDSQAPK | 1115 |
| Z17212 | VDAKYAKETEAAYDEIYGLPNLTRKQYTAFIRKLLDDPSQSSELLSEAKKLNDSQAPK | 1116 |
| Z17213 | VDAKYAKEVEEAYFEIFRLPNLTRKQYTAFIRKLLDDPSQSSELLSEAKKLNDSQAPK | 1117 |
| Z17214 | VDAKYAKEVVKAYFEIYHLPNLTRKQYTAFIRKLLDDPSQSSELLSEAKKLNDSQAPK | 1118 |
| Z17215 | VDAKYAKEVYEAQMEIEIYKLPNLTRKQYTAFIRKLLDDPSQSSELLSEAKKLNDSQAPK | 1119 |
| Z17216 | VDAKYAKEVEDAYIEIYKLPNLTRKQYTAFIRKLLDDPSQSSELLSEAKKLNDSQAPK | 1120 |
| Z17217 | VDAKYAKEVEWAQMEIFNLPNLTRRQYTAFIRKLLDDPSQSSELLSEAKKLNDSQAPK | 1121 |
| Z17218 | VDAKYAKELEKAQMEIFYLPNLTRKQYTAFIRKLFDDPSQSSELLSEAKKLNDSQAPK | 1122 |
| Z17219 | VDAKYAKETEEAYQEIFHLPNLTRKQYTAFIRKLLDDPSQSSELLSEAKKLNDSQAPK | 1123 |
| Z17220 | VDAKYAKEAEDAQMEIFKLPNLTRKQYTAFIRKLLDDPSQSSELLSEAKKLNDSQAPK | 1124 |
| Z17221 | VDAKYAKEIEEAQLEIFNLPNLTRKQYTAFIRKLLDDPSQSSELLSEAKKLNDSQAPK | 1125 |
| Z17222 | VDAKYAKEVEDAYHEIFLLPNLTRKQYTAFIRKLLDDPSQSSELLSEAKKLNDSQAPK | 1126 |
| Z17223 | VDAKYAKEVEYAYHEIFKLPNLTRKQYTAFIRKLLDDPSQSSELLSEAKKLNDSQAPK | 1127 |
| Z17224 | VDAKYAKETVEAQMEIYFLPNLTRKQYTAFIRKLLDDPSQSSELLSEAKKLNDSQAPK | 1128 |
| Z17225 | VDAKYAKEVEDAYMEIYFLPNLTRRQYTAFIRKLLDDPSQSSELLSEAKKLNDSQAPK | 1129 |
| Z17226 | VDAKYAKETETAQMEIYNLPNLTRKQYTAFIIKLLDDPSQSSELLSEAKKLNDSQAPK | 1130 |

FIGURE 1AN

| | | |
|---|---|---|
| Z17227 | VDAKYAKEVEIAQMEIFRLPNLTRKQYTAFIRKLLDDPSQSSELLSEAKKLNDSQAPK | 1131 |
| Z17228 | VDAKYAKEVHLAQMEIFSLPNLTRKQYTAFIRKLLDDPSQSSELLSEAKKLNDSQAPK | 1132 |
| Z17229 | VDAKYAKEVEYAQMEIFSLPNLTRKQYTAFIRKLLDDPSQSSELLSEAKKLNDSQAPK | 1133 |
| Z17230 | VDAKYAKEAEEAQHEIFSLPNLTRKQYTAFIRKLLDDPSQSSELLSEAKKLNDSQAPK | 1134 |
| Z17231 | VDAKYAKEAYVAQMEIFSLPNLTRKQYTAFIRKLLDDPSQSSELLSEAKKLNDSQAPK | 1135 |
| Z17232 | VDAKYAKEVQKAQMEIFELPNLTRKQYTAFIRKLFDDPSQSSELLSEAKKLNDSQAPK | 1136 |
| Z17233 | VDAKYAKEAYAAQHEIFALPNLTRKQYTAFIRKLLDDPSQSSELLSEAKKLNDSQAPK | 1137 |
| Z17234 | VDAKYAKEVERAYYEIYALPNLTRKQYTAFIRKLLDDPSQSSELLSEAKKLNDSQAPK | 1138 |
| Z17235 | VDAKYAKEVEAAQMEIFELPNLTRKQYTAFIRKLLDDPSQSSELLSEAKKLNDSQAPK | 1139 |
| Z17236 | VDAKYAKELENAQMEIFTLPNLTRKQYTAFIRKLLDDPSQSSELLSEAKKLNDSQAPK | 1140 |
| Z17237 | VDAKYAKELEYAQQEIFHLPNLTRKQYTAFIRKLFDDPSQSSELLSEAKKLNDSQAPK | 1141 |
| Z17238 | VDAKYAKEQLNAQMEIFSLPNLTRKQYTAFIRKLLDDPSQSSELLSEAKKLNDSQAPK | 1142 |
| Z17240 | VDAKYAKEVIAAYYEIYDLPNLTRKQYTAFIRKLLDDPSQSSELLSEAKKLNDSQAPK | 1143 |
| Z17241 | VDAKYAKEVVDAYWEIYSLPNLTRKQYTAFIRKLLDDPSQSSELLSEAKKLNDSQAPK | 1144 |
| Z17242 | VDAKYAKEVEEAYQEIFRLPNLTRKQYTAFIRKLLDDPSQSSELLSEAKKLNDSQAPK | 1145 |
| Z17243 | VDAKYAKEAEDAYFEIFALPNLTRKQYTAFIRKLLDDPSQSSELLSEAKKLNDSQAPK | 1146 |
| Z17244 | VDAKYAKEVEDAYFEIYRLPNLTRKQYTAFIRKLLDDPSQSSELLSEAKKLNDSQAPK | 1147 |
| Z17245 | VDAKYAKEVEVAYYEIYRLPNLTRKQYTAFIRKLLDDPSQSSELLSEAKKLNDSQAPK | 1148 |
| Z17246 | VDAKYAKELEDAYMEIFKLPNLTRKQYTAFIRKLLDDPSQSSELLSEAKKLNDSQAPK | 1149 |
| Z17247 | VDAKYAKEVEDEAYWEIYALPNLTRKQYTAFIRKLLDDPSQSSELLSEAKKLNDSQAPK | 1150 |
| Z17248 | VDAKYAKEAEWAYWEIYKLPNLTRKQYTAFIRKLLDDPSQSSELLSEAKKLNDSQAPK | 1151 |
| Z17249 | VDAKYAKEVAYMEIFHLPNLTRKQYTAFIRKLLDDPSQSSELLSEAKKLNDSQAPK | 1152 |
| Z17250 | VDAKYAKETERAYMEIYHLPNLTRKQYTAFIRKLLDDPSQSSELLSEAKKLNDSQAPK | 1153 |
| Z17251 | VDAKYAKEHIAAYFEIYELPNLTRKQYTAFIRKLLDDPSQSSELLSEAKKLNDSQAPK | 1154 |
| Z17252 | VDAKYAKEVEEAYYEIFGLPNLTRKQYTAFIRKLLDDPSQSSELLSEAKKLNDSQAPK | 1155 |
| Z17253 | VDAKYAKEVEDAYQEIYQLPNLTRKQYTAFIRKLLDDPSQSSELLSEAKKLNDSQAPK | 1156 |
| Z17254 | VDAKYAKETVEAYYEIYALPNLTRKQYTAFIRKLLDDPSQSSELLSEAKKLNDSQAPK | 1157 |
| Z17255 | VDAKYAKEVEQAYYEIYALPNLTRKQYTAFIRKLLDDPSQSSELLSEAKKLNDSQAPK | 1158 |
| Z17256 | VDAKYAKEVEAYDEIFALPNLTRKQYTAFIRKLLDDPSQSSELLSEAKKLNDSQAPK | 1159 |

FIGURE 1AO

| | | |
|---|---|---|
| Z17257 | VDAKYAKEVEEAYMEIYGLPNLTRKQYTAFIRKLLDDPSQSSELLSEAKKLNDSQAPK | 1160 |
| Z17258 | VDAKYAKEVDDAYMEIFRLPNLTRKQYTAFIRKLLDDPSQSSELLSEAKKLNDSQAPK | 1161 |
| Z17259 | VDAKYAKEVQDAYMEIYGLPNLTRKQYTAFIRKLLDDPSQSSELLSEAKKLNDSQAPK | 1162 |
| Z17260 | VDAKYAKEAQQAYDEIFQLPNLTRKQYTAFIRKLLDDPSQSSELLSEAKKLNDSQAPK | 1163 |
| Z17261 | VDAKYAKEVEFAYMEIYRLPNLTRKQYTAFIRKLLDDPSQSSELLSEAKKLNDSQAPK | 1164 |
| Z17262 | VDAKYAKEVEIAYFEIYQLPNLTRKQYTAFIRKLLDDPSQSSELLSEAKKLNDSQAPK | 1165 |
| Z17263 | VDAKYAKETEKAYFEIFGLPNLTRKQYTAFIRKLLDDPSQSSELLSEAKKLNDSQAPK | 1166 |
| Z17264 | VDAKYAKEVTNAYMEIYELPNLTRKQYTAFIRKLLDDPSQSSELLSEAKKLNDSQAPK | 1167 |
| Z17266 | VDAKYAKETEEAYFEIFKLPNLTRKQYTAFIRKLLDDPSQSSELLSEAKKLNDSQAPK | 1168 |
| Z17267 | VDAKYAKEVETAYMEIYALPNLTRKQYTAFIRKLLDDPSQSSELLSEAKKLNDSQAPK | 1169 |
| Z17268 | VDAKYAKEAEDAYMEIYKLPNLTRKQYTAFIRKLLDDPSQSSELLSEAKKLNDSQAPK | 1170 |
| Z17269 | VDAKYAKEVEEAYQEIFHLPNLTRKQYTAFIRKLLDDPSQSSELLSEAKKLNDSQAPK | 1171 |
| Z17270 | VDAKYAKETEEAYFEIYRLPNLTRKQYTAFIRKLLDDPSQSSELLSEAKKLNDSQAPK | 1172 |
| Z17271 | VDAKYAKEAISAYWEIFALPNLTRKQYTAFIRKLLDDPSQSSELLSEAKKLNDSQAPK | 1173 |
| Z17272 | VDAKYAKEVEEAYQEIYRLPNLTRKQYTAFIRKLLDDPSQSSELLSEAKKLNDSQAPK | 1174 |
| Z17273 | VDAKYAKEVVYAQHEIFYLPNLTRKQYTAFIRKLLDDPSQSSELLSEAKKLNDSQAPK | 1175 |
| Z17274 | VDAKYAKEIEVAYMEIYHLPNLTRKQYTAFIRKLLDDPSQSSELLSEAKKLNDSQAPK | 1176 |
| Z17275 | VDAKYAKEVEYAYYEIFGLPNLTRKQYTAFIRKLLDDPSQSSELLSEAKKLNDSQAPK | 1177 |
| Z17276 | VDAKYAKEVEQAYMEIFHLPNLTRKQYTAFIRKLLDDPSQSSELLSEAKKLNDSQAPK | 1178 |
| Z17277 | VDAKYAKEVEDAYDEIYQLPNLTRKQYTAFIRKLLDDPSQSSELLSEAKKLNDSQAPK | 1179 |
| Z17278 | VDAKYAKEIERAYYEIYDLPNLTRKQYTAFIRKLLDDPSQSSELLSEAKKLNDSQAPK | 1180 |
| Z17279 | VDAKYAKEVEDAYFEIYYLPNLTRKQYTAFIRKLLDDPSQSSELLSEAKKLNDSQAPK | 1181 |
| Z17280 | VDAKYAKEVEQAYWEIYALPNLTRKQYTAFIRKLLDDPSQSSELLSEAKKLNDSQAPK | 1182 |
| Z17281 | VDAKYAKEVEEAYQEIFKLPNLTRKQYTAFIRKLLDDPSQSSELLSEAKKLNDSQAPK | 1183 |
| Z17282 | VDAKYAKEAEHAYWEIYALPNLTRKQYTAFIRKLLDDPSQSSELLSEAKKLNDSQAPK | 1184 |
| Z17283 | VDAKYAKEVEKAYYEIYNLPNLTRKQYTAFIRKLLDDPSQSSELLSEAKKLNDSQAPK | 1185 |
| Z17284 | VDAKYAKEVEEAYMEIYKLPNLTRKQYTAFIRKLLDDPSQSSELLSEAKKLNDSQAPK | 1186 |
| Z17285 | VDAKYAKEIEDAYQEIYELPNLTRKQYTAFIRKLLDDPSQSSELLSEAKKLNDSQAPK | 1187 |
| Z17286 | VDAKYAKEVENAYYEIFDLPNLTRKQYTAFIRKLLDDPSQSSELLSEAKKLNDSQAPK | 1188 |

FIGURE 1AP

| | | |
|---|---|---|
| Z17287 | VDAKYAKEATEAYWEIYQLPNLTRKQYTAFIRKLLDDPSQSSELLSEAKKLNDSQAPK | 1189 |
| Z17288 | VDAKYAKEADAAYFEIYHLPNLTRKQYTAFIRKLLDDPSQSSELLSEAKKLNDSQAPK | 1190 |
| Z17289 | VDAKYAKEVINAYWEIYALPNLTRKQYTAFIRKLLDDPSQSSELLSEAKKLNDSQAPK | 1191 |
| Z17290 | VDAKYAKEAVDAYWEIFALPNLTRKQYTAFIRKLLDDPSQSSELLSEAKKLNDSQAPK | 1192 |
| Z17291 | VDAKYAKEVEEAYYEIYELPNLTRKQYTAFIRKLLDDPSQSSELLSEAKKLNDSQAPK | 1193 |
| Z17292 | VDAKYAKEVEYAYFEIYSLPNLTRKQYTAFIRKLLDDPSQSSELLSEAKKLNDSQAPK | 1194 |
| Z17293 | VDAKYAKEAEKAYYEIFNLPNLTRKQYTAFIRKLLDDPSQSSELLSEAKKLNDSQAPK | 1195 |
| Z17294 | VDAKYAKETIDAYYEIYGLPNLTRKQYTAFIRKLLDDPSQSSELLSEAKKLNDSQAPK | 1196 |
| Z17295 | VDAKYAKEVEVAYAEIFNLPNLTRKQYTAFIRKLLDDPSQSSELLSEAKKLNDSQAPK | 1197 |
| Z17296 | VDAKYAKEVETAYFEIYALPNLTRKQYTAFIRKLLDDPSQSSELLSEAKKLNDSQAPK | 1198 |
| Z17297 | VDAKYAKEAYIAQMEIFGLPNLTRKQYTAFIRKLLDDPSQSSELLSEAKKLNDSQAPK | 1199 |
| Z17298 | VDAKYAKEVEEAYFEIYNLPNLTRKQYTAFIRKLLDDPSQSSELLSEAKKLNDSQAPK | 1200 |
| Z17299 | VDAKYAKESEAAYWEIYELPNLTRKQYTAFIRKLLDDPSQSSELLSEAKKLNDSQAPK | 1201 |
| Z17300 | VDAKYAKEAEDAYWEIFALPNLTRKQYTAFIRKLLDDPSQSSELLSEAKKLNDSQAPK | 1202 |
| Z17301 | VDAKYAKEVDAAYWEIYGLPNLTRKQYTAFIRKLLDDPSQSSELLSEAKKLNDSQAPK | 1203 |
| Z17302 | VDAKYAKETVDAYYEIYELPNLTRKQYTAFIRKLLDDPSQSSELLSEAKKLNDSQAPK | 1204 |
| Z18557 | VDAKYAKEIEAVQMEIEAVQMEIFYLPNLTRKQYTAFIRKLFDDPSQSSELLSEAKKLNDSQAPK | 1205 |
| Z15876 | VDAKYAKEIEAAQMEIFGLPNLTRKQYTAFIRKLFDDPSQSSELLSEAKKLNDSQAPK | 1206 |
| Z15932 | VDAKYAKEVEEAQMEIFILPNLTRKQYTAFIRKLLDDPSQSSELLSEAKKLNDSQAPK | 1207 |
| Z15934 | VDAKYAKEVTVAQMEIFALPNLTRKQYTAFIRKLLDDPSQSSELLSEAKKLNDSQAPK | 1208 |
| Z15975 | VDAKYAKEVETAQMEIFVLPNLTRKQYTAFIRKLLDDPSQSSELLSEAKKLNDSQAPK | 1209 |
| Z19134 | VDAKYAKEAEDAYWEIYALPNLTRKQYTAFIRKLLDDPSQSSELLSEAKKLNDSQAPK | 1210 |
| Z19125 | VDAKYAKEAIEAYWEIYALPNLTRKQYTAFIRKLLDDPSQSSELLSEAKKLNDSQAPK | 1211 |
| Z19136 | VDAKYAKEVVAAYYEIFELPNLTRKQYTAFIRKLLDDPSQSSELLSEAKKLNDSQAPK | 1212 |
| Z19127 | VDAKYAKEVVSAYYEIYELPNLTRKQYTAFIRKLLDDPSQSSELLSEAKKLNDSQAPK | 1213 |
| Z19138 | VDAKYAKEIEIAYMEIFHLPNLTRKQYTAFIRKLLDDPSQSSELLSEAKKLNDSQAPK | 1214 |
| Z19101 | VDAKYAKELDVAYMEIYRLPNLTRKQYTAFIRKLLDDPSQSSELLSEAKKLNDSQAPK | 1215 |
| Z19095 | VDAKYAKEAEVAYMEIYRLPNLTRKQYTAFIRKLLDDPSQSSELLSEAKKLNDSQAPK | 1216 |
| Z19121 | VDAKYAKELERAYYEIYGLPNLTRKQYTAFIRKLLDDPSQSSELLSEAKKLNDSQAPK | 1217 |

FIGURE 1AQ

| | | |
|---|---|---|
| Z19122 | VDAKYAKEAEIAYYEIYSLPNLTRKQYTAFTIRKLLDDPSQSSELLSEAKKLNDSQAPK | 1218 |
| Z19120 | VDAKYAKETEVAYYEIYALPNLTRKQYTAFIRKLLDDPSQSSELLSEAKKLNDSQAPK | 1219 |
| Z19139 | VDAKYAKEVEAAYWEIYALPNLTRKQYTAFIRKLLDDPSQSSELLSEAKKLNDSQAPK | 1220 |
| Z19058 | VDAKYAKEVEIAYMEIYNLPNLTRKQYTAFIRKLLDDPSQSSELLSEAKKLNDSQAPK | 1221 |
| Z19124 | VDAKYAKEVEVAYFEIYNLPNLTRKQYTAFIRKLLDDPSQSSELLSEAKKLNDSQAPK | 1222 |
| Z19131 | VDAKYAKEHEEAYMEIYHLPNLTRKQYTAFIRKLLDDPSQSSELLSEAKKLNDSQAPK | 1223 |
| Z19103 | VDAKYAKELERAYMEIYHLPNLTRKQYTAFIRKLLDDPSQSSELLSEAKKLNDSQAPK | 1224 |
| Z19088 | VDAKYAKEVEHAYMEIYHLPNLTRKQYTAFIRKLLDDPSQSSELLSEAKKLNDSQAPK | 1225 |
| Z19077 | VDAKYAKEVQEAYMEIFALPNLTRKQYTAFIRKLLDDPSQSSELLSEAKKLNDSQAPK | 1226 |
| Z19111 | VDAKYAKEVKIAQMEIFNLPNLTRKQYTAFIRKLLDDPSQSSELLSEAKKLNDSQAPK | 1227 |
| Z19060 | VDAKYAKEVEWAQMEIFDLPNLTRKQYTAFIRKLLDDPSQSSELLSEAKKLNDSQAPK | 1228 |
| Z19112 | VDAKYAKEAHSAQMEIFALPNLTRKQYTAFIRKLLDDPSQSSELLSEAKKLNDSQAPK | 1229 |
| Z19133 | VDAKYAKEAERAQMEIFALPNLTRRQYTAFIRKLLDDPSQSSELLSEAKKLNDSQAPK | 1230 |
| Z19094 | VDAKYAKETEAAQMEIYKLPNLTRKQYTAFIRKLLDDPSQSSELLSEAKKLNDSQAPK | 1231 |
| Z19093 | VDAKYAKELEQAQMEIFYLPNLTRKQYTAFIRKLFDDPSQSSELLSEAKKLNDSQAPK | 1232 |
| Z19069 | VDAKYAKEVESAQMEIFELPNLTRKQYTAFIRKLLDDPSQSSELLSEAKKLNDSQAPK | 1233 |
| Z19067 | VDAKYAKEVEDAQMEIYQLPNLTRRQYTAFIRKLLDDPSQSSELLSEAKKLNDSQAPK | 1234 |
| Z19183 | VDAKYAKEIEDAQMEIYDLPNLTRKQYTAFIRKLLDDPSQSSELLSEAKKLNDSQAPK | 1235 |
| Z19079 | VDAKYAKEVEQAQMEIFKLPNLTRKQYTAFIRKLLDDPSQSSELLSEAKKLNDSQAPK | 1236 |
| Z19102 | VDAKYAKEVEHAQMEIYSLPNLTRKQYTAFIRKLLDDPSQSSELLSEAKKLNDSQAPK | 1237 |
| Z19110 | VDAKYAKEIEDAQMEIFSLPNLTRKQYTAFIRKLLDDPSQSSELLSEAKKLNDSQAPK | 1238 |
| Z19087 | VDAKYAKEIEDAQMEIFSLPNLTRKQYTAFIRKLLDDPSQSSELLSEAKKLNDSQAPK | 1239 |
| Z19059 | VDAKYAKEVEEAQMEIYGLPNLTRKQYTAFIRKLLDDPSQSSELLSEAKKLNDSQAPK | 1240 |
| Z19123 | VDAKYAKEIEKAQMEIFALPNLTRKQYTAFIRKLLDDPSQSSELLSEAKKLNDSQAPK | 1241 |
| Z19128 | VDAKYAKETYVAQMEIFALPNLTRKQYTAFIRKLLDDPSQSSELLSEAKKLNDSQAPK | 1242 |
| Z19137 | VDAKYAKEVEIAQMEIFYLPNLTRKQYTAFIRKLLDDPSQSSELLSEAKKLNDSQAPK | 1243 |
| Z19068 | VDAKYAKEVKVAQMEIFALPNLTRKQYTAFIRKLFDDPSQSSELLSEAKKLNDSQAPK | 1244 |
| Z19086 | VDAKYAKEVEYAQMEIFALPNLTRKQYTAFIRKLLDDPSQSSELLSEAKKLNDSQAPK | 1245 |
| Z19076 | VDAKYAKEVETAQMEIFYLPNLTRKQYTAFIRKLLDDPSQSSELLSEAKKLNDSQAPK | 1246 |

FIGURE 1AR

| | | |
|---|---|---|
| Z19135 | VDAKYAKEVEAAQMEIFKLPNLTRKQYTAFIRKLLDDPSQSSELLSEAKKLNDSQAPK | 1247 |
| Z19078 | VDAKYAKEIEAAQMEIFGLPNLTRKQYTAFIRKLLDDPSQSSELLSEAKKLNDSQAPK | 1248 |
| Z19066 | VDAKYAKETEAAQMEIYALPNLTRKQYTAFIRKLFDDPSQSSELLSEAKKLNDSQAPK | 1249 |
| Z18906 | VDAKYAKEIETIQHEIYELPNLTRKQYTAFIRKLLDDPSQSSELLSEAKKLNDSQAPK | 1250 |
| Z18912 | VDAKYAKETEEIQMEIFHLPNLTRKQYTAFIRKLLDDPSQSSELLSEAKKLNDSQAPK | 1251 |
| Z18754 | VDAKYAKEVEEIQMEIFRLPNLTRKQYTAFIRKLLDDPSQSSELLSEAKKLNDSQAPK | 1252 |
| Z18767 | VDAKYAKEVEEVYFEIFRLPNLTRKQYTAFIRKLLDDPSQSSELLSEAKKLNDSQAPK | 1253 |
| Z19174 | VDAKYAKETYEVQMEIYHLPNLTRKQYTAFIRKLLDDPSQSSELLSEAKKLNDSQAPK | 1254 |
| Z18802 | VDAKYAKEAERVQMEIFGLPNLTRKQYTAFIRKLLDDPSQSSELLSEAKKLNDSQAPK | 1255 |
| Z18792 | VDAKYAKEAEAIQMEIYDLPNLTRKQYTAFIRKLLDDPSQSSELLSEAKKLNDSQAPK | 1256 |
| Z18783 | VDAKYAKETEVIQMEIFRLPNLTRKQYTAFIRKLLDDPSQSSELLSEAKKLNDSQAPK | 1257 |
| Z18753 | VDAKYAKETEAIQMEIFQLPNLTRKQYTAFIRKLLDDPSQSSELLSEAKKLNDSQAPK | 1258 |
| Z18795 | VDAKYAKETEAIQMEIFRLPNLTRKQYTAFIRKLLDDPSQSSELLSEAKKLNDSQAPK | 1259 |
| Z18929 | VDAKYAKETEAVQMEIFRLPNLTRKQYTAFIRKLLDDPSQSSELLSEAKKLNDSQAPK | 1260 |
| Z19305 | VDAKYAKETEAVQMEIFRLPNLTRKQYTAFIRKLLDDPSQSSELLSEAKKLNDSQAPK | 1261 |
| Z19303 | VDAKYAKETEAVQMEIFTLPNLTRKQYTAFIRKLLDDPSQSSELLSEAKKLNDSQAPK | 1262 |
| Z18899 | VDAKYAKETEAIQMEIFELPNLTRKQYTAFIRKLLDDPSQSSELLSEAKKLNDSQAPK | 1263 |
| Z18824 | VDAKYAKETEAVQMEIFHLPNLTRKQYTAFIRKLLDDPSQSSELLSEAKKLNDSQAPK | 1264 |
| Z18860 | VDAKYAKETEEIQMEIFLLPNLTRKQYTAFIRKLLDDPSQSSELLSEAKKLNDSQAPK | 1265 |
| Z18864 | VDAKYAKETERVQMEIFYLPNLTRKQYTAFIRKLLDDPSQSSELLSEAKKLNDSQAPK | 1266 |
| Z18778 | VDAKYAKETEEVQMEIFQLPNLTRKQYTAFIRKLLDDPSQSSELLSEAKKLNDSQAPK | 1267 |
| Z18798 | VDAKYAKETEEIQMEIFQLPNLTRKQYTAFIRKLLDDPSQSSELLSEAKKLNDSQAPK | 1268 |
| Z18821 | VDAKYAKETEEVQMEIFKLPNLTRKQYTAFIRKLLDDPSQSSELLSEAKKLNDSQAPK | 1269 |
| Z18920 | VDAKYAKETEEVQMEIFRLPNLTRKQYTAFIRKLLDDPSQSSELLSEAKKLNDSQAPK | 1270 |
| Z18806 | VDAKYAKETEEIQMEIFRLPNLTRKQYTAFIRKLLDDPSQSSELLSEAKKLNDSQAPK | 1271 |
| Z18966 | VDAKYAKETEEVQMEIFHLPNLTRKQYTAFIRKLLDDPSQSSELLSEAKKLNDSQAPK | 1272 |
| Z19304 | VDAKYAKETEQVQMEIFHLPNLTRRQYTAFIRKLLDDPSQSSELLSEAKKLNDSQAPK | 1273 |
| Z18766 | VDAKYAKETEQVQMEIFHLPNLTRKQYTAFIRKLLDDPSQSSELLSEAKKLNDSQAPK | 1274 |
| Z18825 | VDAKYAKETEKVQMEIFGLPNLTRKQYTAFIRKLFDDPSQSSELLSEAKKLNDSQAPK | 1275 |

FIGURE 1AS

| | | |
|---|---|---|
| Z18819 | VDAKYAKETEEVQMEIFGLPNLTRRQYTAFIRKLLDDPSQSSELLSEAKKLNDSQAPK | 1276 |
| Z18822 | VDAKYAKETEEIQMEIYGLPNLTRKQYTAFIRKLLDDPSQSSELLSEAKKLNDSQAPK | 1277 |
| Z18810 | VDAKYAKETEEVQMEIFGLPNLTRKQYTAFIRKLLDDPSQSSELLSEAKKLNDSQAPK | 1278 |
| Z18892 | VDAKYAKETEAVQMEIFGLPNLTRKQYTAFIRKLFDDPSQSSELLSEAKKLNDSQAPK | 1279 |
| Z18854 | VDAKYAKETEVVQMEIFGLPNLTRRQYTAFIRKLLDDPSQSSELLSEAKKLNDSQAPK | 1280 |
| Z18758 | VDAKYAKETEVVQMEIFGLPNLTRRQYTAFIRKLLDDPSQSSELLSEAKKLNDSQAPK | 1281 |
| Z18823 | VDAKYAKETEEVQMEIFSLPNLTRRQYTAFIRKLLDDPSQSSELLSEAKKLNDSQAPK | 1282 |
| Z18958 | VDAKYAKETEEIQMEIFSLPNLTRKQYTAFIRKLLDDPSQSSELLSEAKKLNDSQAPK | 1283 |
| Z18770 | VDAKYAKETERVQMEIFSLPNLTRRQYVAFIRKLLDDPSQSSELLSEAKKLNDSQAPK | 1284 |
| Z18898 | VDAKYAKELEAIQMEIFYLPNLTRKQYTAFIRKLLDDPSQSSELLSEAKKLNDSQAPK | 1285 |
| Z18876 | VDAKYAKEIEEIQMEIFYLPNLTRRQYVAFIRKLLDDPSQSSELLSEAKKLNDSQAPK | 1286 |
| Z18840 | VDAKYAKELEKVQMEIFVLPNLTRKQYTAFIRKLLDDPSQSSELLSEAKKLNDSQAPK | 1287 |
| Z18900 | VDAKYAKELERIQMEIFYLPNLTRKQYTAFIRKLLDDPSQSSELLSEAKKLNDSQAPK | 1288 |
| Z18775 | VDAKYAKELEKVQMEIFYLPNLTRKQYTAFIRKLLDDPSQSSELLSEAKKLNDSQAPK | 1289 |
| Z18952 | VDAKYAKEVEQIQMEIFYLPNLTRKQYTAFIRKLLDDPSQSSELLSEAKKLNDSQAPK | 1290 |
| Z18851 | VDAKYAKEIEQIQMEIFYLPNLTRKQYTAFIRKLLDDPSQSSELLSEAKKLNDSQAPK | 1291 |
| Z19152 | VDAKYAKEIEQVQMEIFYLPNLTRKQYTAFIRKLLDDPSQSSELLSEAKKLNDSQAPK | 1292 |
| Z18765 | VDAKYAKEIEQIQMEIFYLPNLTRRQYTAFIRKLLDDPSQSSELLSEAKKLNDSQAPK | 1293 |
| Z18885 | VDAKYAKEVEVEIQMEIFYLPNLTRRQYTAFIRKLFDDPSQSSELLSEAKKLNDSQAPK | 1294 |
| Z18830 | VDAKYAKEVEEIQMEIFYLPNLTRKQYTAFIRKLLDDPSQSSELLSEAKKLNDSQAPK | 1295 |
| Z18828 | VDAKYAKEVEEITQMEIFYLPNLTRKQYTAFIRKLLDDPSQSSELLSEAKKLNDSQAPK | 1296 |
| Z18833 | VDAKYAKEVEEVQMEIFYLPNLTRKQYTAFIRKLLDDPSQSSELLSEAKKLNDSQAPK | 1297 |
| Z18853 | VDAKYAKEIEEVQMEIFYLPNLTRKQYTAFIRKLFDDPSQSSELLSEAKKLNDSQAPK | 1298 |
| Z18849 | VDAKYAKEIEEVQMEIFYLPNLTRKQYTAFIRKLLDDPSQSSELLSEAKKLNDSQAPK | 1299 |
| Z18902 | VDAKYAKEIEEIQMEIFYLPNLTRRQYTAFIRKLLDDPSQSSELLSEAKKLNDSQAPK | 1300 |
| Z18877 | VDAKYAKELEEIQMEIFYLPNLTRKQYTAFIRKLLDDPSQSSELLSEAKKLNDSQAPK | 1301 |
| Z18878 | VDAKYAKEVEEVQMEIFFLPNLTRKQYTAFIRKLLDDPSQSSELLSEAKKLNDSQAPK | 1302 |
| Z18909 | VDAKYAKEIEEIQMEIFFLPNLTRRQYTAFIRKLLDDPSQSSELLSEAKKLNDSQAPK | 1303 |
| Z18848 | VDAKYAKEIEEIQMEIFLPNLTRKQYTAFIRKLLDDPSQSSELLSEAKKLNDSQAPK | 1304 |

FIGURE 1AT

| | | |
|---|---|---|
| Z19166 | VDAKYAKELEEVQMEIYFLPNLTRRQYTAFIRKLLDDPSQSSELLSEAKKLNDSQAPK | 1305 |
| Z18873 | VDAKYAKELEEVQMEIFYLPNLTRRQYTAFIRKLLDDPSQSSELLSEAKKLNDSQAPK | 1306 |
| Z19147 | VDAKYAKELEEIQMEIFYLPNLTRRQYTAFIRKLLDDPSQSSELLSEAKKLNDSQAPK | 1307 |
| Z18831 | VDAKYAKEIEEVQMEIFYLPNLTRRQYTAFIRKLLDDPSQSSELLSEAKKLNDSQAPK | 1308 |
| Z18843 | VDAKYAKEIEEIQMEIFYLPNLTRRQYTAFIRKLLDDPSQSSELLSEAKKLNDSQAPK | 1309 |
| Z19153 | VDAKYAKEIEEIQMEIFDLPNLTRRQYTAFIRKLLDDPSQSSELLSEAKKLNDSQAPK | 1310 |
| Z18882 | VDAKYAKEVEEVQMEIFDLPNLTRRQYTAFIRKLLDDPSQSSELLSEAKKLNDSQAPK | 1311 |
| Z18894 | VDAKYAKELEEIQMEIFDLPNLTRRQYTAFIRKLLDDPSQSSELLSEAKKLNDSQAPK | 1312 |
| Z18940 | VDAKYAKELERIQMEIFHLPNLTRRQYTAFIRKLLDDPSQSSELLSEAKKLNDSQAPK | 1313 |
| Z18759 | VDAKYAKELEKVQMEIFHLPNLTRKQYTAFIRKLLDDPSQSSELLSEAKKLNDSQAPK | 1314 |
| Z18855 | VDAKYAKELEKVQMEIFRLPNLTRRQYTAFIRKLLDDPSQSSELLSEAKKLNDSQAPK | 1315 |
| Z18837 | VDAKYAKELEKVQMEIFRLPNLTRRQYTAFIRKLLDDPSQSSELLSEAKKLNDSQAPK | 1316 |
| Z18788 | VDAKYAKEVEKIQMEIFRLPNLTRRQYTAFIRKLLDDPSQSSELLSEAKKLNDSQAPK | 1317 |
| Z18827 | VDAKYAKETEKVQMEIFRLPNLTRRQYTAFIRKLLDDPSQSSELLSEAKKLNDSQAPK | 1318 |
| Z18761 | VDAKYAKEIEEVQMEIFRLPNLTRKQYTAFIRKLLDDPSQSSELLSEAKKLNDSQAPK | 1319 |
| Z18786 | VDAKYAKELEEVQMEIFRLPNLTRKQYTAFIRKLFDDPSQSSELLSEAKKLNDSQAPK | 1320 |
| Z18757 | VDAKYAKEIEEIQMEIFRLPNLTRKQYTAFIRKLFDDPSQSSELLSEAKKLNDSQAPK | 1321 |
| Z18858 | VDAKYAKEIEEIQMEIFHLPNLTRRQYTAFIRKLFDDPSQSSELLSEAKKLNDSQAPK | 1322 |
| Z18785 | VDAKYAKELEEIQMEIFHLPNLTRKQYTAFIRKLLDDPSQSSELLSEAKKLNDSQAPK | 1323 |
| Z18866 | VDAKYAKEIEEIQMEIFHLPNLTRKQYTAFIRKLLDDPSQSSELLSEAKKLNDSQAPK | 1324 |
| Z19145 | VDAKYAKELEETVQMEIFRLPNLTRKQYTAFIRKLLDDPSQSSELLSEAKKLNDSQAPK | 1325 |
| Z18777 | VDAKYAKEIEQVQMEIFRLPNLTRKQYTAFIRKLLDDPSQSSELLSEAKKLNDSQAPK | 1326 |
| Z18803 | VDAKYAKEIEQIQMEIFRLPNLTRKQYTAFIRKLLDDPSQSSELLSEAKKLNDSQAPK | 1327 |
| Z18800 | VDAKYAKEIEEIQMEIFRLPNLTRKQYTAFIRKLLDDPSQSSELLSEAKKLNDSQAPK | 1328 |
| Z18804 | VDAKYAKEIEEIQMEIFHLPNLTRRQYTAFIRKLLDDPSQSSELLSEAKKLNDSQAPK | 1329 |
| Z18856 | VDAKYAKELEEIQMEIFHLPNLTRKQYTAFIRKLLDDPSQSSELLSEAKKLNDSQAPK | 1330 |
| Z18846 | VDAKYAKEIEEIEEIQMEIFHLPNLTRKQYTAFIRKLFDDPSQSSELLSEAKKLNDSQAPK | 1331 |
| Z18871 | VDAKYAKEVEEIQMEIFHLPNLTRKQYTAFIRKLFDDPSQSSELLSEAKKLNDSQAPK | 1332 |
| Z18782 | VDAKYAKEVEEVQMEIFELPNLTRRQYTAFIRKLLDDPSQSSELLSEAKKLNDSQAPK | 1333 |

FIGURE 1AU

| | | |
|---|---|---|
| Z19170 | VDAKYAKEVEEIQMEIFELPNLTRRQYTAFIRKLLDDPSQSSELLSEAKKLNDSQAPK | 1334 |
| Z18949 | VDAKYAKEVEQVQMEIFHLPNLTRRQYTAFIRKLLDDPSQSSELLSEAKKLNDSQAPK | 1335 |
| Z18852 | VDAKYAKEVEQIQMEIFHLPNLTRKQYTAFIRKLLDDPSQSSELLSEAKKLNDSQAPK | 1336 |
| Z18838 | VDAKYAKEVEEIQMEIFHLPNLTRKQYTAFIRKLLDDPSQSSELLSEAKKLNDSQAPK | 1337 |
| Z18928 | VDAKYAKEVEEVQMEIFHLPNLTRKQYTAFIRKLLDDPSQSSELLSEAKKLNDSQAPK | 1338 |
| Z18769 | VDAKYAKEVEEVQMEIFHLPNLTRRQYTAFIRKLLDDPSQSSELLSEAKKLNDSQAPK | 1339 |
| Z18832 | VDAKYAKEVEEIQMEIFHLPNLTRRQYTAFIRKLLDDPSQSSELLSEAKKLNDSQAPK | 1340 |
| Z18771 | VDAKYAKEVEEIQMEIFRLPNLTRKQYTAFIRKLLDDPSQSSELLSEAKKLNDSQAPK | 1341 |
| Z18808 | VDAKYAKEVEEVQMEIFRLPNLTRKQYTAFIRKLLDDPSQSSELLSEAKKLNDSQAPK | 1342 |
| Z18817 | VDAKYAKEVEEIQMEIFRLPNLTRRQYTAFIRKLFDDPSQSSELLSEAKKLNDSQAPK | 1343 |
| Z18889 | VDAKYAKEVEEVQMEIFRLPNLTRRQYTAFIRKLLDDPSQSSELLSEAKKLNDSQAPK | 1344 |
| Z18930 | VDAKYAKEVERIQMEIFSLPNLTRKQYTAFIRKLLDDPSQSSELLSEAKKLNDSQAPK | 1345 |
| Z18812 | VDAKYAKEVEKIQMEIFSLPNLTRKQYTAFIRKLLDDPSQSSELLSEAKKLNDSQAPK | 1346 |
| Z18809 | VDAKYAKEIETVQMEIFSLPNLTRKQYTAFIRKLLDDPSQSSELLSEAKKLNDSQAPK | 1347 |
| Z18768 | VDAKYAKELETVQMEIFSLPNLTRKQYTAFIRKLLDDPSQSSELLSEAKKLNDSQAPK | 1348 |
| Z18844 | VDAKYAKELEEIQMEIFSLPNLTRKQYTAFIRKLFDDPSQSSELLSEAKKLNDSQAPK | 1349 |
| Z18919 | VDAKYAKEIEEIQMEIFSLPNLTRKQYTAFIRKLFDDPSQSSELLSEAKKLNDSQAPK | 1350 |
| Z18931 | VDAKYAKELETVQMEIFSLPNLTRRQYTAFIRKLLDDPSQSSELLSEAKKLNDSQAPK | 1351 |
| Z18890 | VDAKYAKELEKVQMEIFGLPNLTRKQYTAFIRKLLDDPSQSSELLSEAKKLNDSQAPK | 1352 |
| Z18893 | VDAKYAKEIEEIQMEIFGLPNLTRKQYTAFIRKLLDDPSQSSELLSEAKKLNDSQAPK | 1353 |
| Z18796 | VDAKYAKELEEVQMEIFGLPNLTRKQYTAFIRKLLDDPSQSSELLSEAKKLNDSQAPK | 1354 |
| Z18881 | VDAKYAKEIEEIQMEIFGLPNLTRKQYTAFIRKLFDDPSQSSELLSEAKKLNDSQAPK | 1355 |
| Z18826 | VDAKYAKEIEEVQMEIFGLPNLTRKQYTAFIRKLFDDPSQSSELLSEAKKLNDSQAPK | 1356 |
| Z18959 | VDAKYAKEIEEVQMEIFGLPNLTRKQYTAFIRKLLDDPSQSSELLSEAKKLNDSQAPK | 1357 |
| Z18897 | VDAKYAKEVEEIQMEIFGLPNLTRRQYTAFIRKLFDDPSQSSELLSEAKKLNDSQAPK | 1358 |
| Z18841 | VDAKYAKEVEEIQMEIFGLPNLTRRQYTAFIRKLLDDPSQSSELLSEAKKLNDSQAPK | 1359 |
| Z18918 | VDAKYAKEVEEVQMEIFGLPNLTRRQYTAFIRKLLDDPSQSSELLSEAKKLNDSQAPK | 1360 |
| Z18834 | VDAKYAKEVEEVQMEIFGLPNLTRRQYTAFIRKLLDDPSQSSELLSEAKKLNDSQAPK | 1361 |
| Z18863 | VDAKYAKEVEEVQMEIFGLPNLTRRQYTAFIRKLFDDPSQSSELLSEAKKLNDSQAPK | 1362 |

FIGURE 1AV

| | | |
|---|---|---|
| Z18847 | VDAKYAKETEEVQMEIFALPNLTRKQYTAFIRKLLDDPSQSSELLSEAKKLNDSQAPK | 1363 |
| Z19159 | VDAKYAKETEEVQMEIFALPNLTRRQYTAFIRKLLDDPSQSSELLSEAKKLNDSQAPK | 1364 |
| Z18789 | VDAKYAKEIEQIQMEIFALPNLTRRQYTAFIRKLLDDPSQSSELLSEAKKLNDSQAPK | 1365 |
| Z18756 | VDAKYAKEIEEIQMEIFALPNLTRRQYTAFIRKLLDDPSQSSELLSEAKKLNDSQAPK | 1366 |
| Z18850 | VDAKYAKEIEEIQMEIFALPNLTRRQYTAFIRKLLDDPSQSSELLSEAKKLNDSQAPK | 1367 |
| Z18814 | VDAKYAKEVEEIQMEIFALPNLTRRQYTAFIRKLLDDPSQSSELLSEAKKLNDSQAPK | 1368 |
| Z18861 | VDAKYAKEVEEVQMEIFALPNLTRRQYTAFIRKLLDDPSQSSELLSEAKKLNDSQAPK | 1369 |
| Z18938 | VDAKYAKEIEQIQMEIFALPNLTRKQYTAFIRKLLDDPSQSSELLSEAKKLNDSQAPK | 1370 |
| Z18801 | VDAKYAKEIEQVQMEIFALPNLTRKQYTAFIRKLFDDPSQSSELLSEAKKLNDSQAPK | 1371 |
| Z18927 | VDAKYAKEIEEIQMEIFALPNLTRKQYTAFIRKLFDDPSQSSELLSEAKKLNDSQAPK | 1372 |
| Z18951 | VDAKYAKEIEEVQMEIFALPNLTRKQYTAFIRKLLDDPSQSSELLSEAKKLNDSQAPK | 1373 |
| Z19144 | VDAKYAKEIEEVQMEIEYIQMEIFDDPSQSSELLSEAKKLNDSQAPK | 1374 |
| Z18813 | VDAKYAKEVEEIQMEIFHLPNLTRRQYTAFIRKLLDDPSQSSELLSEAKKLNDSQAPK | 1375 |
| Z18859 | VDAKYAKETEIVQMEIFHLPNLTRRQYTAFIRKLLDDPSQSSELLSEAKKLNDSQAPK | 1376 |
| Z18797 | VDAKYAKETEIVQMEIFHLPNLTRKQYTAFIRKLLDDPSQSSELLSEAKKLNDSQAPK | 1377 |
| Z18781 | VDAKYAKETEIVQMEIFGLPNLTRKQYTAFIRKLLDDPSQSSELLSEAKKLNDSQAPK | 1378 |
| Z19160 | VDAKYAKEIEIIQMEIFYLPNLTRKQYTAFIRKLLDDPSQSSELLSEAKKLNDSQAPK | 1379 |
| Z18891 | VDAKYAKEIEYIQMEIFYLPNLTRRQYTAFIRKLLDDPSQSSELLSEAKKLNDSQAPK | 1380 |
| Z18857 | VDAKYAKEIEVVQMEIFYLPNLTRRQYTAFIRKLLDDPSQSSELLSEAKKLNDSQAPK | 1381 |
| Z18816 | VDAKYAKELEVIQMEIFELPNLTRRQYTAFIRKLLDDPSQSSELLSEAKKLNDSQAPK | 1382 |
| Z18829 | VDAKYAKETEIVQMEIFHLPNLTRRQYTAFIRKLLDDPSQSSELLSEAKKLNDSQAPK | 1383 |
| Z18787 | VDAKYAKEVEVIQMEIFRLPNLTRKQYTAFIRKLLDDPSQSSELLSEAKKLNDSQAPK | 1384 |
| Z18791 | VDAKYAKEVEVIQMEIFRLPNLTRKQYTAFIRKLLDDPSQSSELLSEAKKLNDSQAPK | 1385 |
| Z18887 | VDAKYAKEVEVVQMEIFRLPNLTRKQYTAFIRKLLDDPSQSSELLSEAKKLNDSQAPK | 1386 |
| Z18773 | VDAKYAKELEVIQMEIFRLPNLTRRQYTAFIRKLLDDPSQSSELLSEAKKLNDSQAPK | 1387 |
| Z18967 | VDAKYAKELEVIQMEIFKLPNLTRRQYTAFIRKLLDDPSQSSELLSEAKKLNDSQAPK | 1388 |
| Z18774 | VDAKYAKEIEVIQMEIFRLPNLTRRQYTAFIRKLLDDPSQSSELLSEAKKLNDSQAPK | 1389 |
| Z18879 | VDAKYAKEVEYIQMEIFRLPNLTRRQYTAFIRKLLDDPSQSSELLSEAKKLNDSQAPK | 1390 |
| Z18868 | VDAKYAKELEIVQMEIFHLPNLTRRQYTAFIRKLLDDPSQSSELLSEAKKLNDSQAPK | 1391 |

FIGURE 1AW

| ID | Sequence | # |
|---|---|---|
| Z18903 | VDAKYAKELEIIQMEIFHLPNLTRRQYTAFIRKLLDDPSQSSELLSEAKKLNDSQAPK | 1392 |
| Z19180 | VDAKYAKEVEIIQMEIFHLPNLTRRQYTAFIRKQYTAFIRKLLDDPSQSSELLSEAKKLNDSQAPK | 1393 |
| Z18901 | VDAKYAKELEVIQMEIFALPNLTRKQYTAFIRKLLDDPSQSSELLSEAKKLNDSQAPK | 1394 |
| Z18755 | VDAKYAKELEVIQMEIFALPNLTRKQYTAFIRKLFDDPSQSSELLSEAKKLNDSQAPK | 1395 |
| Z18883 | VDAKYAKEVEIIQMEIFALPNLTRKQYTAFIRKLFDDPSQSSELLSEAKKLNDSQAPK | 1396 |
| Z19164 | VDAKYAKEVEIIQMEIFALPNLTRKQYTAFIRKLLDDPSQSSELLSEAKKLNDSQAPK | 1397 |
| Z18845 | VDAKYAKEVEVIQMEIFSLPNLTRKQYTAFIRKLLDDPSQSSELLSEAKKLNDSQAPK | 1398 |
| Z18965 | VDAKYAKEVEVVQMEIFSLPNLTRKQYTAFIRKLLDDPSQSSELLSEAKKLNDSQAPK | 1399 |
| Z18807 | VDAKYAKELEIVQMEIFGLPNLTRKQYTAFIRKLLDDPSQSSELLSEAKKLNDSQAPK | 1400 |
| Z18818 | VDAKYAKELEYIQMEIFGLPNLTRKQYTAFIRKLLDDPSQSSELLSEAKKLNDSQAPK | 1401 |
| Z19169 | VDAKYAKEVEVIQMEIFGLPNLTRKQYTAFIRKLLDDPSQSSELLSEAKKLNDSQAPK | 1402 |
| Z18884 | VDAKYAKEVEIIQMEIFGLPNLTRKQYTAFIRKLLDDPSQSSELLSEAKKLNDSQAPK | 1403 |
| Z18793 | VDAKYAKEVETVQMEIFRLPNLTRKQYTAFIRKLLDDPSQSSELLSEAKKLNDSQAPK | 1404 |
| Z18811 | VDAKYAKELETVQMEIFHLPNLTRKQYTAFIRKLLDDPSQSSELLSEAKKLNDSQAPK | 1405 |
| Z18880 | VDAKYAKELEAIQMEIFTLPNLTRKQYTAFIRKLLDDPSQSSELLSEAKKLNDSQAPK | 1406 |
| Z19154 | VDAKYAKELEAIQMEIYYLPNLTRKQYTAFIRKLLDDPSQSSELLSEAKKLNDSQAPK | 1407 |
| Z18869 | VDAKYAKELEAIQMEIFYLPNLTRKQYTAFIRKLLDDPSQSSELLSEAKKLNDSQAPK | 1408 |
| Z18941 | VDAKYAKELEAVQMEIFYLPNLTRKQYTAFIRKLLDDPSQSSELLSEAKKLNDSQAPK | 1409 |
| Z18872 | VDAKYAKELEAVQMEIFYLPNLTRKQYTAFIRKLLDDPSQSSELLSEAKKLNDSQAPK | 1410 |
| Z18895 | VDAKYAKELEAIQMEIFFLPNLTRKQYTAFIRKLLDDPSQSSELLSEAKKLNDSQAPK | 1411 |
| Z19165 | VDAKYAKELEAIQMEIFFLPNLTRKQYTAFIRKLLDDPSQSSELLSEAKKLNDSQAPK | 1412 |
| Z18862 | VDAKYAKELEAIQMEIFFLPNLTRKQYTAFIRKLLDDPSQSSELLSEAKKLNDSQAPK | 1413 |
| Z18948 | VDAKYAKELEAIQMEIFRLPNLTRKQYTAFIRKLLDDPSQSSELLSEAKKLNDSQAPK | 1414 |
| Z18762 | VDAKYAKELEAIQMEIFRLPNLTRKQYTAFIRKLLDDPSQSSELLSEAKKLNDSQAPK | 1415 |
| Z18910 | VDAKYAKELEAIQMEIFRLPNLTRKQYTAFIRKLLDDPSQSSELLSEAKKLNDSQAPK | 1416 |
| Z18820 | VDAKYAKELEAIQMEIFRLPNLTRKQYTAFIRKLLDDPSQSSELLSEAKKLNDSQAPK | 1417 |
| Z18776 | VDAKYAKEVEAVQMEIFHLPNLTRKQYTAFIRKLLDDPSQSSELLSEAKKLNDSQAPK | 1418 |
| Z19302 | VDAKYAKEIEAIQMEIFHLPNLTRRQYTAFIRKLLDDPSQSSELLSEAKKLNDSQAPK | 1419 |
| Z18875 | VDAKYAKEIEAIQMEIFHLPNLTRRQYTAFIRKLLDDPSQSSELLSEAKKLNDSQAPK | 1420 |

FIGURE 1AX

| ID | Sequence | # |
|---|---|---|
| Z18874 | VDAKYAKELEAIQMEIFHLPNLTRRQYTAFIRKLLDDPSQSSELLSEAKKLNDSQAPK | 1421 |
| Z18888 | VDAKYAKEVEAIQMEIFHLPNLTRKQYTAFIRKLLDDPSQSSELLSEAKKLNDSQAPK | 1422 |
| Z18799 | VDAKYAKEVEAIQMEIFHLPNLTRKQYTAFIRKLFDDPSQSSELLSEAKKLNDSQAPK | 1423 |
| Z18794 | VDAKYAKEVEAVQMEIFSLPNLTRRQYTAFIRKLLDDPSQSSELLSEAKKLNDSQAPK | 1424 |
| Z18939 | VDAKYAKEIEAVQMEIFSLPNLTRRQYTAFIRKLLDDPSQSSELLSEAKKLNDSQAPK | 1425 |
| Z18815 | VDAKYAKELEAIQMEIFSLPNLTRKQYTAFIRKLLDDPSQSSELLSEAKKLNDSQAPK | 1426 |
| Z18764 | VDAKYAKELEAVQMEIFSLPNLTRKQYTAFIRKLLDDPSQSSELLSEAKKLNDSQAPK | 1427 |
| Z18870 | VDAKYAKEIEAIQMEIFGLPNLTRRQYTAFIRKLFDDPSQSSELLSEAKKLNDSQAPK | 1428 |
| Z18950 | VDAKYAKEVEAIQMEIFGLPNLTRKQYTAFIRKLLDDPSQSSELLSEAKKLNDSQAPK | 1429 |
| Z18836 | VDAKYAKEVEAIQMEIFGLPNLTRKQYTAFIRKLLDDPSQSSELLSEAKKLNDSQAPK | 1430 |
| Z18763 | VDAKYAKEIEAVQMEIFGLPNLTRKQYTAFIRKLLDDPSQSSELLSEAKKLNDSQAPK | 1431 |
| Z18886 | VDAKYAKEIEAIQMEIFGLPNLTRKQYTAFIRKLLDDPSQSSELLSEAKKLNDSQAPK | 1432 |
| Z18784 | VDAKYAKETEAIQMEIFALPNLTRKQYTAFIRKLLDDPSQSSELLSEAKKLNDSQAPK | 1433 |
| Z19146 | VDAKYAKETEAVQMEIFALPNLTRKQYTAFIRKLLDDPSQSSELLSEAKKLNDSQAPK | 1434 |
| Z18760 | VDAKYAKETEAVQMEIFALPNLTRRQYTAFIRKLLDDPSQSSELLSEAKKLNDSQAPK | 1435 |
| Z18896 | VDAKYAKETEAIQMEIFALPNLTRRQYTAFIRKLLDDPSQSSELLSEAKKLNDSQAPK | 1436 |
| Z18805 | VDAKYAKEIEAVQMEIFALPNLTRRQYTAFIRKLFDDPSQSSELLSEAKKLNDSQAPK | 1437 |
| Z18779 | VDAKYAKEIEAIQMEIFALPNLTRRQYTAFIRKLLDDPSQSSELLSEAKKLNDSQAPK | 1438 |
| Z18790 | VDAKYAKEVEAVQMEIFALPNLTRRQYTAFIRKLLDDPSQSSELLSEAKKLNDSQAPK | 1439 |
| Z18839 | VDAKYAKEVEAVQMEIFALPNLTRKQYTAFIRKLLDDPSQSSELLSEAKKLNDSQAPK | 1440 |
| Z18911 | VDAKYAKEVKIYFEIFALPNLTRKQYTAFIRKLLDDPSQSSELLSEAKKLNDSQAPK | 1441 |
| Z19036 | VDAKYAKEVVKIYFEIYDLPNLTRKQYTAFIRKLLDDPSQSSELLSEAKKLNDSQAPK | 1442 |
| Z19035 | VDAKYAKEVIDVYFEIYLPNLTRKQYTAFIRKLLDDPSQSSELLSEAKKLNDSQAPK | 1443 |
| Z19175 | VDAKYAKEVVHIYFEIFGLPNLTRKQYTAFIRKLLDDPSQSSELLSEAKKLNDSQAPK | 1444 |
| Z19034 | VDAKYAKEVVEVYFEIYFEIFALPNLTRKQYTAFIRKLLDDPSQSSELLSEAKKLNDSQAPK | 1445 |
| Z19051 | VDAKYAKEVVEIYFEIFALPNLTRKQYTAFIRKLLDDPSQSSELLSEAKKLNDSQAPK | 1446 |
| Z19027 | VDAKYAKEVVEVYFEIYFEIFALPNLTRKQYTAFIRKLLDDPSQSSELLSEAKKLNDSQAPK | 1447 |
| Z19062 | VDAKYAKEIERIYFEIYGLPNLTRKQYTAFIRKLLDDPSQSSELLSEAKKLNDSQAPK | 1448 |
| Z19096 | VDAKYAKEIEKIYFEIYDLPNLTRKQYTAFIRKLLDDPSQSSELLSEAKKLNDSQAPK | 1449 |

FIGURE 1AY

| | | |
|---|---|---|
| Z19070 | VDAKYAKEIEKVYFEIYDLPNLTRRQYTAFIRKLLDDPSQSSELLSEAKKLNDSQAPK | 1450 |
| Z19030 | VDAKYAKEVEKIYYEIYELPNLTRKQYTAFIRKLLDDPSQSSELLSEAKKLNDSQAPK | 1451 |
| Z19050 | VDAKYAKETEHVYFEIYQLPNLTRKQYTAFIRKLLDDPSQSSELLSEAKKLNDSQAPK | 1452 |
| Z19063 | VDAKYAKETEKAYYEIYDLPNLTRKQYTAFIRKLLDDPSQSSELLSEAKKLNDSQAPK | 1453 |
| Z18960 | VDAKYAKETERVYYEIYSLPNLTRKQYTAFIRKLLDDPSQSSELLSEAKKLNDSQAPK | 1454 |
| Z19142 | VDAKYAKETEIVYFEIFGLPNLTRKQYTAFIRKLLDDPSQSSELLSEAKKLNDSQAPK | 1455 |
| Z19055 | VDAKYAKEVEFAYWEIYALPNLTRKQYTAFIRKLLDDPSQSSELLSEAKKLNDSQAPK | 1456 |
| Z19065 | VDAKYAKEVEVVYFEIFALPNLTRKQYTAFIRKLLDDPSQSSELLSEAKKLNDSQAPK | 1457 |
| Z19156 | VDAKYAKEVESAYFEIYDLPNLTRKQYTAFIRKLLDDPSQSSELLSEAKKLNDSQAPK | 1458 |
| Z19116 | VDAKYAKEVEAVYYEIYQLPNLTRKQYTAFIRKLLDDPSQSSELLSEAKKLNDSQAPK | 1459 |
| Z19083 | VDAKYAKEVEVAYYEIYGLPNLTRKQYTAFIRKLLDDPSQSSELLSEAKKLNDSQAPK | 1460 |
| Z19037 | VDAKYAKEVEDVYFEIFELPNLTRRQYTAFIRKLLDDPSQSSELLSEAKKLNDSQAPK | 1461 |
| Z18954 | VDAKYAKEVETVYYEIFKLPNLTRKQYTAFIRKLLDDPSQSSELLSEAKKLNDSQAPK | 1462 |
| Z19163 | VDAKYAKEVEQVYFEIYFLPNLTRKQYTAFIRKLLDDPSQSSELLSEAKKLNDSQAPK | 1463 |
| Z19092 | VDAKYAKEVEEIYQEIYRLPNLTRKQYTAFIRKLLDDPSQSSELLSEAKKLNDSQAPK | 1464 |
| Z19157 | VDAKYAKEVEEIYFEIFGLPNLTRKQYTAFIRKLLDDPSQSSELLSEAKKLNDSQAPK | 1465 |
| Z18978 | VDAKYAKELEAVQLEIFALPNLTRKQYTAFIIKLLDDPSQSSELLSEAKKLNDSQAPK | 1466 |
| Z19041 | VDAKYAKEIEKIQLEIFALPNLTRKQYTAFIIKLFDDPSQSSELLSEAKKLNDSQAPK | 1467 |
| Z19113 | VDAKYAKEVEEVQLEIFALPNLTRKQYTAFIIKLFDDPSQSSELLSEAKKLNDSQAPK | 1468 |
| Z18924 | VDAKYAKEVEDVQLEIFALPNLTRKQYTAFIIKLLDDPSQSSELLSEAKKLNDSQAPK | 1469 |
| Z18996 | VDAKYAKEIEQVQLEIYKLPNLTRKQYTAFIIKLLDDPSQSSELLSEAKKLNDSQAPK | 1470 |
| Z19143 | VDAKYAKEVEEIQLEIFHLPNLTRKQYTAFIIKLLDDPSQSSELLSEAKKLNDSQAPK | 1471 |
| Z18968 | VDAKYAKELEEVQLEIFRLPNLTRRQYTAFIRKLFDDPSQSSELLSEAKKLNDSQAPK | 1472 |
| Z19179 | VDAKYAKEIEDVQHEIFGLPNLTRKQYTAFIRKLFDDPSQSSELLSEAKKLNDSQAPK | 1473 |
| Z19009 | VDAKYAKEVEKVQQEIFGLPNLTRKQYTAFIRKLFDDPSQSSELLSEAKKLNDSQAPK | 1474 |
| Z19003 | VDAKYAKEIEAIQHEIFALPNLTRKQYTAFIRKLFDDPSQSSELLSEAKKLNDSQAPK | 1475 |
| Z18979 | VDAKYAKEIEAIQHEIFVLPNLTRKQYTAFIRKLLDDPSQSSELLSEAKKLNDSQAPK | 1476 |
| Z18972 | VDAKYAKEIERIQHEIFALPNLTRKQYTAFIRKLLDDPSQSSELLSEAKKLNDSQAPK | 1477 |
| Z18935 | VDAKYAKEIEVIQHEIFGLPNLTRKQYTAFIRKLLDDPSQSSELLSEAKKLNDSQAPK | 1478 |

FIGURE 1AZ

| | | |
|---|---|---|
| Z18925 | VDAKYAKETEDIQQEIFQLPNLTRRQYTAFIRKLLDDPSQSSELLSEAKKLNDSQAPK | 1479 |
| Z19098 | VDAKYAKEVESIQQEIFQLPNLTRKQYTAFIRKLLDDPSQSSELLSEAKKLNDSQAPK | 1480 |
| Z19109 | VDAKYAKEVERIQQEIFHLPNLTRKQYTAFIRKLLDDPSQSSELLSEAKKLNDSQAPK | 1481 |
| Z18923 | VDAKYAKEIEEIQQEIFHLPNLTRRQYTAFIRKLLDDPSQSSELLSEAKKLNDSQAPK | 1482 |
| Z18942 | VDAKYAKEVETIQHEIFRLPNLTRKQYTAFIRKLFDDPSQSSELLSEAKKLNDSQAPK | 1483 |
| Z19167 | VDAKYAKETEVVQFEIFRLPNLTRRQYTAFIRKLFDDPSQSSELLSEAKKLNDSQAPK | 1484 |
| Z19017 | VDAKYAKETEAVQLEIFELPNLTRKQYTAFIRKLLDDPSQSSELLSEAKKLNDSQAPK | 1485 |
| Z19011 | VDAKYAKETEDVQLEIFRLPNLTRKQYTAFIRKLLDDPSQSSELLSEAKKLNDSQAPK | 1486 |
| Z18905 | VDAKYAKEAEKIQFEIFSLPNLTRRQYTAFIRKLLDDPSQSSELLSEAKKLNDSQAPK | 1487 |
| Z18913 | VDAKYAKETEEIQLEIYSLPNLTRKQYTAFIRKLLDDPSQSSELLSEAKKLNDSQAPK | 1488 |
| Z19115 | VDAKYAKETEEIQLEIFSLPNLTRKQYTAFIRKLFDDPSQSSELLSEAKKLNDSQAPK | 1489 |
| Z18975 | VDAKYAKETEKIQYEIFSLPNLTRRQYTAFIRKLLDDPSQSSELLSEAKKLNDSQAPK | 1490 |
| Z19045 | VDAKYAKEIEQIQYEIFYLPNLTRKQYTAFIRKLLDDPSQSSELLSEAKKLNDSQAPK | 1491 |
| Z18998 | VDAKYAKEIETVQYEIFVLPNLTRKQYTAFIRKLLDDPSQSSELLSEAKKLNDSQAPK | 1492 |
| Z18992 | VDAKYAKEIEAVQYEIYYLPNLTRKQYTAFIRKLLDDPSQSSELLSEAKKLNDSQAPK | 1493 |
| Z18932 | VDAKYAKELEHIQYEIFFLPNLTRKQYTAFIRKLLDDPSQSSELLSEAKKLNDSQAPK | 1494 |
| Z19052 | VDAKYAKEVEEIQYEIFWLPNLTRKQYTAFIRKLLDDPSQSSELLSEAKKLNDSQAPK | 1495 |
| Z19042 | VDAKYAKEVEEIQYEIFFLPNLTRKQYTAFIRKLLDDPSQSSELLSEAKKLNDSQAPK | 1496 |
| Z19029 | VDAKYAKEVEEVQIEIYYLPNLTRKQYTAFIRKLLDDPSQSSELLSEAKKLNDSQAPK | 1497 |
| Z19005 | VDAKYAKEVEDVQLEIYLPNLTRKQYTAFIRKLLDDPSQSSELLSEAKKLNDSQAPK | 1498 |
| Z19149 | VDAKYAKEIEVQLEIFVLPNLTRKQYTAFIRKLLDDPSQSSELLSEAKKLNDSQAPK | 1499 |
| Z19168 | VDAKYAKEIERIQMEIFYLPNLTRKQYTAFIRKLFDDPSQSSELLSEAKKLNDSQAPK | 1500 |
| Z19038 | VDAKYAKELEQVQMEIFYLPNLTRKQYTAFIRKLFDDPSQSSELLSEAKKLNDSQAPK | 1501 |
| Z19148 | VDAKYAKEVEEIQFEIFYLPNLTRRQYTAFIRKLLDDPSQSSELLSEAKKLNDSQAPK | 1502 |
| Z19028 | VDAKYAKEIEEIQFEIFEIQMEIFYLPNLTRKQYTAFIRKLLDDPSQSSELLSEAKKLNDSQAPK | 1503 |
| Z19155 | VDAKYAKEIEEIQMEIYYLPNLTRKQYTAFIRKLLDDPSQSSELLSEAKKLNDSQAPK | 1504 |
| Z19043 | VDAKYAKEVEEIQHEIYDLPNLTRKQYTAFIRKLLDDPSQSSELLSEAKKLNDSQAPK | 1505 |
| Z19141 | VDAKYAKEVEEIQHEIYDLPNLTRKQYTAFIRKLLDDPSQSSELLSEAKKLNDSQAPK | 1506 |
| Z19016 | VDAKYAKEIETIQLEIFDLPNLTRRQYTAFIRKLLDDPSQSSELLSEAKKLNDSQAPK | 1507 |

FIGURE 1BA

| ID | Sequence | # |
|---|---|---|
| Z18991 | VDAKYAKEIETVQYEIYDLPNLTRKQYTAFIRKLLDDPSQSSELLSEAKKLNDSQAPK | 1508 |
| Z18917 | VDAKYAKEIEEIQFEIYDLPNLTRKQYTAFIRKLFDDPSQSSELLSEAKKLNDSQAPK | 1509 |
| Z18980 | VDAKYAKEVEEIQLEIYDLPNLTRKQYTAFIRKLLDDPSQSSELLSEAKKLNDSQAPK | 1510 |
| Z18947 | VDAKYAKEVEEVQLEIFDLPNLTRKQYTAFIRKLLDDPSQSSELLSEAKKLNDSQAPK | 1511 |
| Z19023 | VDAKYAKEIEEVQLEIFDLPNLTRRQYTAFIRKLLDDPSQSSELLSEAKKLNDSQAPK | 1512 |
| Z18907 | VDAKYAKEIEEIQIEIFDLPNLTRKQYTAFIRKLLDDPSQSSELLSEAKKLNDSQAPK | 1513 |
| Z18981 | VDAKYAKEVESVQFEIYHLPNLTRKQYTAFIRKLLDDPSQSSELLSEAKKLNDSQAPK | 1514 |
| Z19091 | VDAKYAKEIESIQIEIFELPNLTRKQYTAFIRKLLDDPSQSSELLSEAKKLNDSQAPK | 1515 |
| Z18943 | VDAKYAKEIESIQLEIFHLPNLTRKQYTAFIRKLLDDPSQSSELLSEAKKLNDSQAPK | 1516 |
| Z19040 | VDAKYAKEVEDIQLEIFDLPNLTRKQYTAFIRKLLDDPSQSSELLSEAKKLNDSQAPK | 1517 |
| Z19033 | VDAKYAKEVEDIQYEIFELPNLTRKQYTAFIRKLLDDPSQSSELLSEAKKLNDSQAPK | 1518 |
| Z18914 | VDAKYAKEVEDIQLEIFELPNLTRKQYTAFIRKLLDDPSQSSELLSEAKKLNDSQAPK | 1519 |
| Z19089 | VDAKYAKEIEDIQYEIFELPNLTRKQYTAFIRKLLDDPSQSSELLSEAKKLNDSQAPK | 1520 |
| Z18963 | VDAKYAKEIEDIQLEIFELPNLTRKQYTAFIRKLLDDPSQSSELLSEAKKLNDSQAPK | 1521 |
| Z19061 | VDAKYAKEIEDIQIEIYHLPNLTRKQYTAFIRKLLDDPSQSSELLSEAKKLNDSQAPK | 1522 |
| Z19100 | VDAKYAKEIEDIQIEIFHLPNLTRKQYTAFIRKLLDDPSQSSELLSEAKKLNDSQAPK | 1523 |
| Z18946 | VDAKYAKEIEDVQLEIFQLPNLTRKQYTAFIRKLLDDPSQSSELLSEAKKLNDSQAPK | 1524 |
| Z19018 | VDAKYAKEIEDIQLEIFKLPNLTRKQYTAFIRKLLDDPSQSSELLSEAKKLNDSQAPK | 1525 |
| Z19053 | VDAKYAKEIEDVQLEIFKLPNLTRRQYTAFIRKLLDDPSQSSELLSEAKKLNDSQAPK | 1526 |
| Z18990 | VDAKYAKEVEKIQFEIFKLPNLTRKQYTAFIRKLLDDPSQSSELLSEAKKLNDSQAPK | 1527 |
| Z19054 | VDAKYAKEIEWVQLEIFHLPNLTRKQYTAFIRKLLDDPSQSSELLSEAKKLNDSQAPK | 1528 |
| Z19008 | VDAKYAKELERIQLEIFHLPNLTRKQYTAFIRKLLDDPSQSSELLSEAKKLNDSQAPK | 1529 |
| Z18953 | VDAKYAKELEKIQLEIYHLPNLTRKQYTAFIRKLLDDPSQSSELLSEAKKLNDSQAPK | 1530 |
| Z18921 | VDAKYAKEIEKVQLEIFQLPNLTRKQYTAFIRKLLDDPSQSSELLSEAKKLNDSQAPK | 1531 |
| Z18995 | VDAKYAKEIEEIQLEIYHLPNLTRKQYTAFIRKLFDDPSQSSELLSEAKKLNDSQAPK | 1532 |
| Z18922 | VDAKYAKEIEEIQFEIFKLPNLTRKQYTAFIRKLLDDPSQSSELLSEAKKLNDSQAPK | 1533 |
| Z19108 | VDAKYAKEIEEIEIQYEIFHLPNLTRKQYTAFIRKLLDDPSQSSELLSEAKKLNDSQAPK | 1534 |
| Z19007 | VDAKYAKEIEEIQYEIFHLPNLTRKQYTAFIRKLLDDPSQSSELLSEAKKLNDSQAPK | 1535 |
| Z18916 | VDAKYAKEIEEIQLEIFHLPNLTRKQYTAFIRKLLDDPSQSSELLSEAKKLNDSQAPK | 1536 |

FIGURE 1BB

| ID | Sequence | # |
|---|---|---|
| Z19105 | VDAKYAKELEEIQLEIYKLPNLTRRQYTAFIRKLLDDPSQSSELLSEAKKLNDSQAPK | 1537 |
| Z19104 | VDAKYAKELEEIQLEIYHLPNLTRRQYTAFIRKLLDDPSQSSELLSEAKKLNDSQAPK | 1538 |
| Z18976 | VDAKYAKEIEQVQLEIFHLPNLTRRQYTAFIRKLLDDPSQSSELLSEAKKLNDSQAPK | 1539 |
| Z19090 | VDAKYAKEIEEVQMEIFHLPNLTRKQYTAFIRKLLDDPSQSSELLSEAKKLNDSQAPK | 1540 |
| Z19019 | VDAKYAKEVEEIQIEIFKLPNLTRKQYTAFIRKLFDDPSQSSELLSEAKKLNDSQAPK | 1541 |
| Z18997 | VDAKYAKEVEEVQLEIFKLPNLTRKQYTAFIRKLLDDPSQSSELLSEAKKLNDSQAPK | 1542 |
| Z18973 | VDAKYAKEVEEIQVEIFQLPNLTRKQYTAFIRKLFDDPSQSSELLSEAKKLNDSQAPK | 1543 |
| Z19048 | VDAKYAKEVEEVQLEIFHLPNLTRKQYTAFIRKLFDDPSQSSELLSEAKKLNDSQAPK | 1544 |
| Z19150 | VDAKYAKEVEEIQLEIFHLPNLTRKQYTAFIRKLLDDPSQSSELLSEAKKLNDSQAPK | 1545 |
| Z19024 | VDAKYAKEVEEVQLEIFQLPNLTRKQYTAFIRKLLDDPSQSSELLSEAKKLNDSQAPK | 1546 |
| Z18915 | VDAKYAKEVEEVQIEIFELPNLTRKQYTAFIRKLLDDPSQSSELLSEAKKLNDSQAPK | 1547 |
| Z19099 | VDAKYAKEVEEIQLEIFRLPNLTRKQYTAFIRKLLDDPSQSSELLSEAKKLNDSQAPK | 1548 |
| Z19181 | VDAKYAKEVEEVQLEIYSLPNLTRKQYTAFIRKLLDDPSQSSELLSEAKKLNDSQAPK | 1549 |
| Z19025 | VDAKYAKEIEQIQLEIFSLPNLTRKQYTAFIRKLLDDPSQSSELLSEAKKLNDSQAPK | 1550 |
| Z19172 | VDAKYAKELEDVQLEIFSLPNLTRKQYTAFIRKLFDDPSQSSELLSEAKKLNDSQAPK | 1551 |
| Z19084 | VDAKYAKEIEQIQMEIFSLPNLTRKQYTAFIRKLLDDPSQSSELLSEAKKLNDSQAPK | 1552 |
| Z18982 | VDAKYAKEIEEVQLEIFSLPNLTRKQYTAFIRKLLDDPSQSSELLSEAKKLNDSQAPK | 1553 |
| Z19072 | VDAKYAKEIEEIQLEIDQVEIYGLPNLTRKQYTAFIRKLLDDPSQSSELLSEAKKLNDSQAPK | 1554 |
| Z18937 | VDAKYAKEIEDIQVEIYGLPNLTRRQYTAFIRKLLDDPSQSSELLSEAKKLNDSQAPK | 1555 |
| Z19049 | VDAKYAKELETVQLEIFGLPNLTRKQYTAFIRKLLDDPSQSSELLSEAKKLNDSQAPK | 1556 |
| Z19080 | VDAKYAKEIETIQLEIFGLPNLTRKQYTAFIRKLLDDPSQSSELLSEAKKLNDSQAPK | 1557 |
| Z19057 | VDAKYAKEIEQVQLEIFGLPNLTRKQYTAFIRKLLDDPSQSSELLSEAKKLNDSQAPK | 1558 |
| Z18971 | VDAKYAKEIESVQLEIFGLPNLTRKQYTAFIRKLLDDPSQSSELLSEAKKLNDSQAPK | 1559 |
| Z18986 | VDAKYAKEVEEVQLEIFGLPNLTRKQYTAFIRKLLDDPSQSSELLSEAKKLNDSQAPK | 1560 |
| Z19071 | VDAKYAKEIEEIQLEIFGLPNLTRKQYTAFIRKLLDDPSQSSELLSEAKKLNDSQAPK | 1561 |
| Z19020 | VDAKYAKEVEEVQFEIFGLPNLTRKQYTAFIRKLLDDPSQSSELLSEAKKLNDSQAPK | 1562 |
| Z19082 | VDAKYAKEVEEIQFEIFGLPNLTRKQYTAFIRKLLDDPSQSSELLSEAKKLNDSQAPK | 1563 |
| Z19085 | VDAKYAKEVEEIQYEIFGLPNLTRKQYTAFIRKLLDDPSQSSELLSEAKKLNDSQAPK | 1564 |
| Z19015 | VDAKYAKEVEEIQLEIFGLPNLTRRQYTAFIRKLLDDPSQSSELLSEAKKLNDSQAPK | 1565 |

FIGURE 1BC

| | | |
|---|---|---|
| Z19107 | VDAKYAKETEEVQYEIFALPNLTRKQYTAFIRKLLDDPSQSSELLSEAKKLNDSQAPK | 1566 |
| Z19081 | VDAKYAKETEHIQYEIFALPNLTRKQYTAFIRKLLDDPSQSSELLSEAKKLNDSQAPK | 1567 |
| Z19001 | VDAKYAKETEQVQYEIFALPNLTRKQYTAFIRKLLDDPSQSSELLSEAKKLNDSQAPK | 1568 |
| Z19000 | VDAKYAKETEKIQFEIFALPNLTRKQYTAFIRKLLDDPSQSSELLSEAKKLNDSQAPK | 1569 |
| Z19014 | VDAKYAKETEEIQLEIYALPNLTRRQYTAFIRKLLDDPSQSSELLSEAKKLNDSQAPK | 1570 |
| Z19158 | VDAKYAKETEEIQMEIFALPNLTRRQYTAFIRKLLDDPSQSSELLSEAKKLNDSQAPK | 1571 |
| Z18974 | VDAKYAKEIESIQYEIFALPNLTRKQYTAFIRKLFDDPSQSSELLSEAKKLNDSQAPK | 1572 |
| Z19074 | VDAKYAKEIESVQLEIFALPNLTRKQYTAFIRKLFDDPSQSSELLSEAKKLNDSQAPK | 1573 |
| Z19176 | VDAKYAKEIESIQLEIFALPNLTRKQYTAFIRKLLDDPSQSSELLSEAKKLNDSQAPK | 1574 |
| Z18962 | VDAKYAKELESVQLEIFALPNLTRKQYTAFIRKLLDDPSQSSELLSEAKKLNDSQAPK | 1575 |
| Z19021 | VDAKYAKEIETIQYEIFALPNLTRKQYTAFIRKLLDDPSQSSELLSEAKKLNDSQAPK | 1576 |
| Z19006 | VDAKYAKEVETVQYEIFALPNLTRKQYTAFIRKLLDDPSQSSELLSEAKKLNDSQAPK | 1577 |
| Z19073 | VDAKYAKEIEQIQYEIFALPNLTRKQYTAFIRKLLDDPSQSSELLSEAKKLNDSQAPK | 1578 |
| Z19118 | VDAKYAKEIEHVQYEIFALPNLTRKQYTAFIRKLLDDPSQSSELLSEAKKLNDSQAPK | 1579 |
| Z19097 | VDAKYAKEIEHIQLEIFALPNLTRKQYTAFIRKLFDDPSQSSELLSEAKKLNDSQAPK | 1580 |
| Z18987 | VDAKYAKEVQLEIFALPNLTRKQYTAFIRKLFDDPSQSSELLSEAKKLNDSQAPK | 1581 |
| Z18977 | VDAKYAKEIEEVQLEIYALPNLTRKQYTAFIRKLLDDPSQSSELLSEAKKLNDSQAPK | 1582 |
| Z18955 | VDAKYAKEVEQVQFEIFALPNLTRKQYTAFIRKLLDDPSQSSELLSEAKKLNDSQAPK | 1583 |
| Z18933 | VDAKYAKEVEQIQLEIFALPNLTRKQYTAFIRKLLDDPSQSSELLSEAKKLNDSQAPK | 1584 |
| Z18988 | VDAKYAKEVEEVQYEIFALPNLTRKQYTAFIRKLLDDPSQSSELLSEAKKLNDSQAPK | 1585 |
| Z19056 | VDAKYAKEVEETQLETYALPNLTRKQYTAFIRKLLDDPSQSSELLSEAKKLNDSQAPK | 1586 |
| Z18904 | VDAKYAKEVEEIQLEIFALPNLTRKQYTAFIRKLLDDPSQSSELLSEAKKLNDSQAPK | 1587 |
| Z19012 | VDAKYAKEVEEVQLEIFALPNLTRRQYTAFIRKLLDDPSQSSELLSEAKKLNDSQAPK | 1588 |
| Z19047 | VDAKYAKEVEEIQLEIFALPNLTRKQYTAFIRKLLDDPSQSSELLSEAKKLNDSQAPK | 1589 |
| Z19064 | VDAKYAKEIEEIQFEIFALPNLTRKQYTAFIRKLLDDPSQSSELLSEAKKLNDSQAPK | 1590 |
| Z18908 | VDAKYAKEIEIQLEIFALPNLTRKQYTAFIRKLLDDPSQSSELLSEAKKLNDSQAPK | 1591 |
| Z18989 | VDAKYAKEIEDVQLEIFALPNLTRKQYTAFIRKLLDDPSQSSELLSEAKKLNDSQAPK | 1592 |
| Z19171 | VDAKYAKEIEDIQLEIFGLPNLTRKQYTAFIRKLLDDPSQSSELLSEAKKLNDSQAPK | 1593 |
| Z19151 | VDAKYAKEVEDIQLEIFALPNLTRRQYTAFIRKLLDDPSQSSELLSEAKKLNDSQAPK | 1594 |

FIGURE 1BD

| ID | Sequence | # |
|---|---|---|
| Z19002 | VDAKYAKETEVVQYEIFALPNLTRKQYTAFIRKLLDDPSQSSELLSEAKKLNDSQAPK | 1595 |
| Z18936 | VDAKYAKEAEIVQYEIFALPNLTRKQYTAFIRKLLDDPSQSSELLSEAKKLNDSQAPK | 1596 |
| Z18969 | VDAKYAKEVEFVQYEIFQLPNLTRRQYTAFIRKLLDDPSQSSELLSEAKKLNDSQAPK | 1597 |
| Z18983 | VDAKYAKEIEIVQFEIFHLPNLTRKQYTAFIRKLLDDPSQSSELLSEAKKLNDSQAPK | 1598 |
| Z19044 | VDAKYAKEVEIIQLEIFHLPNLTRRQYTAFIRKLLDDPSQSSELLSEAKKLNDSQAPK | 1599 |
| Z19031 | VDAKYAKEVETIQLEIFALPNLTRKQYTAFIRKLLDDPSQSSELLSEAKKLNDSQAPK | 1600 |
| Z19022 | VDAKYAKEVEYIQLEIFALPNLTRRQYTAFIRKLLDDPSQSSELLSEAKKLNDSQAPK | 1601 |
| Z18970 | VDAKYAKEIELIQLEIYALPNLTRKQYTAFIRKLFDDPSQSSELLSEAKKLNDSQAPK | 1602 |
| Z18945 | VDAKYAKEIEYVQFEIFALPNLTRKQYTAFIRKLLDDPSQSSELLSEAKKLNDSQAPK | 1603 |
| Z19010 | VDAKYAKEIEVIQYEIFALPNLTRKQYTAFIRKLLDDPSQSSELLSEAKKLNDSQAPK | 1604 |
| Z18944 | VDAKYAKEIEVIQLEIFALPNLTRKQYTAFIRKLLDDPSQSSELLSEAKKLNDSQAPK | 1605 |
| Z19026 | VDAKYAKEIEVIQLEIFALPNLTRKQYTAFIRKLFDDPSQSSELLSEAKKLNDSQAPK | 1606 |
| Z19039 | VDAKYAKEVEYIQMEIFALPNLTRKQYTAFIRKLFDDPSQSSELLSEAKKLNDSQAPK | 1607 |
| Z18934 | VDAKYAKEIEVVQFEIFALPNLTRKQYTAFIRKLLDDPSQSSELLSEAKKLNDSQAPK | 1608 |
| Z19178 | VDAKYAKEVEVIQLEIYALPNLTRKQYTAFIRKLLDDPSQSSELLSEAKKLNDSQAPK | 1609 |
| Z19114 | VDAKYAKEVEVIQYEIFALPNLTRKQYTAFIRKLLDDPSQSSELLSEAKKLNDSQAPK | 1610 |
| Z19032 | VDAKYAKEVEVIQLEIFSLPNLTRRQYTAFIRKLLDDPSQSSELLSEAKKLNDSQAPK | 1611 |
| Z19162 | VDAKYAKELEIIQLEIFSLPNLTRRQYTAFIRKLLDDPSQSSELLSEAKKLNDSQAPK | 1612 |
| Z18994 | VDAKYAKEIEVVQLEIFGLPNLTRRQYTAFIRKLLDDPSQSSELLSEAKKLNDSQAPK | 1613 |
| Z18984 | VDAKYAKEIEVVQLEIFGLPNLTRKQYTAFIRKLLDDPSQSSELLSEAKKLNDSQAPK | 1614 |
| Z19161 | VDAKYAKEIEIIQMEIFGLPNLTRRQYTAFIRKLLDDPSQSSELLSEAKKLNDSQAPK | 1615 |
| Z18985 | VDAKYAKEVEVVQFEIYGLPNLTRKQYTAFIRKLLDDPSQSSELLSEAKKLNDSQAPK | 1616 |
| Z18957 | VDAKYAKEVEYVQLEIYGLPNLTRKQYTAFIRKLLDDPSQSSELLSEAKKLNDSQAPK | 1617 |
| Z19075 | VDAKYAKEVEIIQYEIFGLPNLTRKQYTAFIRKLLDDPSQSSELLSEAKKLNDSQAPK | 1618 |
| Z19046 | VDAKYAKELEAIQMEIFVLPNLTRRQYTAFIRKLLDDPSQSSELLSEAKKLNDSQAPK | 1619 |
| Z19173 | VDAKYAKEVEAIQMEIFFLPNLTRRQYTAFIRKLLDDPSQSSELLSEAKKLNDSQAPK | 1620 |
| Z19004 | VDAKYAKELEAIQLEIYELPNLTRKQYTAFIRKLLDDPSQSSELLSEAKKLNDSQAPK | 1621 |
| Z18993 | VDAKYAKEVEAIQFEIFQLPNLTRKQYTAFIRKLLDDPSQSSELLSEAKKLNDSQAPK | 1622 |
| Z19177 | VDAKYAKEVEAIQFEIYHLPNLTRKQYTAFIRKLLDDPSQSSELLSEAKKLNDSQAPK | 1623 |

FIGURE 1BE

| | | |
|---|---|---|
| Z18926 | VDAKYAKEVEAIQLEIYHLPNLTRKQYTAFIRKLFDDPSQSSELLSEAKKLNDSQAPK | 1624 |
| Z18956 | VDAKYAKEIEAVQIEIFRLPNLTRKQYTAFIRKLLDDPSQSSELLSEAKKLNDSQAPK | 1625 |
| Z18961 | VDAKYAKEIEAIQLEIFHLPNLTRKQYTAFIRKLFDDPSQSSELLSEAKKLNDSQAPK | 1626 |
| Z18772 | VDAKYAKEIEAIQMEIFHLPNLTRKQYTAFIRKLFDDPSQSSELLSEAKKLNDSQAPK | 1627 |
| Z19182 | VDAKYAKEVEAIQMEIFQLPNLTRKQYTAFIRKLLDDPSQSSELLSEAKKLNDSQAPK | 1628 |
| Z18964 | VDAKYAKEIEAIQYEIFALPNLTRKQYTAFIRKLLDDPSQSSELLSEAKKLNDSQAPK | 1629 |
| Z19013 | VDAKYAKEIEAIQLEIYALPNLTRKQYTAFIRKLLDDPSQSSELLSEAKKLNDSQAPK | 1630 |
| Z19117 | VDAKYAKEIEAIQLEIFALPNLTRKQYTAFIRKLLDDPSQSSELLSEAKKLNDSQAPK | 1631 |
| Z18999 | VDAKYAKEVEAVQLEIFALPNLTRRQYTAFIRKLLDDPSQSSELLSEAKKLNDSQAPK | 1632 |
| Z18581 | AEAKYAKEAEEAYYEIFGLPNLTRRQYTAFIRKLLDDPSQSSELLSEAKKLNDSQAPK | 1633 |
| Z18591 | AEAKYAKEADAAYMEIFGLPNLTRKQYTAFIRKLFDDPSQSSELLSEAKKLNDSQAPK | 1634 |
| Z18607 | AEAKYAKEIEAVQMEIFYLPNLTRKQYTAFIRKLLDDPSQSSELLSEAKKLNDSQAPK | 1635 |
| Z18573 | AEAKYAKEIEAAQMEIFGLPNLTRKQYTAFIRKLFDDPSQSSELLSEAKKLNDSQAPK | 1636 |
| Z18574 | AEAKYAKELEAAYMEIYYLPNLTRKQYTAFIRKLLDDPSQSSELLSEAKKLNDSQAPK | 1637 |
| Z18603 | AEAKYAKEAEKAYYEIFNLPNLTRKQYTAFIRKLLDDPSQSSELLSEAKKLNDSQAPK | 1638 |
| PSIO405 | AEAKYAKEAHRAQMEIFALPNLTRRQYTAFIRKLLDDPSQSSELLSEAKKLSESQAPKVEGSLAEAK | 1639 |
| PSIO407 | AEAKYAKEALSAQQEIFALPNLTRRQYTAFIRKLLDDPSQSSELLSEAKKLSESQAPKVEGSLAEAK<br>EAANAELDSYGVSDFYKRLIDKAKTVEGVEALKDAILAALP | 1640 |
| PSIO411 | ASLAEAKEAANAELDSYGVSDFYKRLIDKAKTVEGVEALKDAILAALPGSAEAKYAKEAHRAQMEIF<br>ALPNLTR<br>RQYTAFIRKLLDDPSQSSELLSEAKKLSESQAPK | 1641 |
| PSIO412 | ASLAEAKEAANAELDSYGVSDFYKRLIDKAKTVEGVEALKDAILAALPGGGGSGGGGSAEAKYAKEA<br>HRAQMEIFALPNLTRRQYTAFIRKLLDDPSQSSELLSEAKKLSESQAPK | 1642 |
| PSIO415 | ASLAEAKEAANAELDSYGVSDFYKRLIDKAKTVEGVEALKDAILAALPAEAKYAKEAHRAQMEIFAL<br>PNLTRRQ<br>YTAFIRKLLDDPSQSSELLSEAKKLSESQAPK | 1643 |
| PSIO416 | ASLAEAKEAANAELDSYGVSDFYKRLIDKAKTVEGVEALKDAILAALPKYAKEAHRAQMEIFALPNL<br>TRRQYTAFIRKLLDDPSQSSELLSEAKKLSESQAPK | 1644 |

FIGURE 1BF

| PSI0417 | ASLAEAKEAANAELDSYGVSDFYKRLIDKAKTVEGVEALKDAILAALPKEAAAKEAAAKEAAAKELA AKEAAAKEAAAKELAAAEAKYAKEAHRAQMEIFALPNLTRRQYTAFIRKLLDDPSQSSELLS EAKKLSESQAPK | 1645 |
|---|---|---|
| PSI0534 | AEAKYAKEIEEVQMEIFYLPNLTRRQYTAFIRKLLDDPSQSSELLSEAKKLSESQAPKASGGGGSGG GGSDKTHTCPPCPAPELLGGPSVFLFPPKPKDTLMISRTPEVTCVVVDVSHEDPEVKFNWYVDGVEV HNAKTKPREEQYNSTYRVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDGSFFLYSKLTVDKSRWQ QGNVFSCSVMHEALHNHYTQKSLSLSPGK | 1646 |
| PSI0535 | AEAKYAKEIEEIQMEIFHLPNLTRRQYTAFIRKLLDDPSQSSELLSEAKKLSESQAPKASGGGGSGG GGSDKTHTCPPCPAPELLGGPSVFLFPPKPKDTLMISRTPEVTCVVVDVSHEDPEVKFNWYVDGVEV HNAKTKPREEQYNSTYRVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDGSFFLYSKLTVDKSRWQ QGNVFSCSVMHEALHNHYTQKSLSLSPGK | 1647 |
| PSI0536 | AEAKYAKEVEEIQMEIFRLPNLTRRQYTAFIRKLLDDPSQSSELLSEAKKLSESQAPKASGGGGSGG GGSDKTHTCPPCPAPELLGGPSVFLFPPKPKDTLMISRTPEVTCVVVDVSHEDPEVKFNWYVDGVEV HNAKTKPREEQYNSTYRVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDGSFFLYSKLTVDKSRWQ QGNVFSCSVMHEALHNHYTQKSLSLSPGK | 1648 |
| PSI0537 | AEAKYAKEVEDIQLEIFALPNLTRRQYTAFIRKLLDDPSQSSELLSEAKKLSESQAPKASGGGGSGG GGSDKTHTCPPCPAPELLGGPSVFLFPPKPKDTLMISRTPEVTCVVVDVSHEDPEVKFNWYVDGVEV HNAKTKPREEQYNSTYRVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDGSFFLYSKLTVDKSRWQ QGNVFSCSVMHEALHNHYTQKSLSLSPGK | 1649 |
| PSI0538 | AEAKYAKELEAIQMEIFHLPNLTRRQYTAFIRKLLDDPSQSSELLSEAKKLSESQAPKASGGGGSGG GGSDKTHTCPPCPAPELLGGPSVFLFPPKPKDTLMISRTPEVTCVVVDVSHEDPEVKFNWYVDGVEV HNAKTKPREEQYNSTYRVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDGSFFLYSKLTVDKSRWQ QGNVFSCSVMHEALHNHYTQKSLSLSPGK | 1650 |

FIGURE 1BG

| | | |
|---|---|---|
| PSI0539 | AEAKYAKETEAVQMEIFALPNLTRRQYTAFIRKLLDDPSQSSELLSEAKKLSESQAPKASGGGGSGG<br>GGSDKTHTCPPCPAPELLGGPSVFLFPPKPKDTLMISRTPEVTCVVVDVSHEDPEVKFNWYVDGVEV<br>HNAKTKPREEQYNSTYRVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDGSFFLYSKLTVDKSRWQ<br>QGNVFSCSVMHEALHNHYTQKSLSLSPGK | 1651 |
| PSI0574 | AEAKYAKEIEEIQMEIFRLPNLTRRQYTAFIRKLLDDPSQSSELLSEAKKLSESQAPKASGGGGSGG<br>GGSDKTHTCPPCPAPELLGGPSVFLFPPKPKDTLMISRTPEVTCVVVDVSHEDPEVKFNWYVDGVEV<br>HNAKTKPREEQYNSTYRVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDGSFFLYSKLTVDKSRWQ<br>QGNVFSCSVMHEALHNHYTQKSLSLSPGK | 1652 |
| PSI0575 | AEAKYAKELEAIQMEIFYLPNLTRRQYVAFIRKLLDDPSQSSELLSEAKKLSESQAPKASGGGGSGG<br>GGSDKTHTCPPCPAPELLGGPSVFLFPPKPKDTLMISRTPEVTCVVVDVSHEDPEVKFNWYVDGVEV<br>HNAKTKPREEQYNSTYRVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDGSFFLYSKLTVDKSRWQ<br>QGNVFSCSVMHEALHNHYTQKSLSLSPGK | 1653 |
| PSI0576 | AEAKYAKELEEIQMEIFYLPNLTRRQYTAFIRKLLDDPSQSSELLSEAKKLSESQAPKASGGGGSGG<br>GGSDKTHTCPPCPAPELLGGPSVFLFPPKPKDTLMISRTPEVTCVVVDVSHEDPEVKFNWYVDGVEV<br>HNAKTKPREEQYNSTYRVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDGSFFLYSKLTVDKSRWQ<br>QGNVFSCSVMHEALHNHYTQKSLSLSPGK | 1654 |
| PSI0580 | AEAKYAKEVEEIQMEIFRLPNLTRRQYTAFIRKLLDDPSQSSELLSEAKKLSESQAPKASGGGGSGG<br>GGSDAHKSEVAHRFKDLGEENFKALVLIAFAQYLQQCPFEDHVKLVNEVTEFAKTCVADESAENCDK<br>SLHTLFGDKLCTVATLRETYGEMADCCAKQEPERNECFLQHKDDNPNLPRLVRPEVDVMCTAFHDNE<br>ETFLKKYLYEIARRHPYFYAPELLFFAKRYKAAFTECCQAADKAACLLPKLDELRDEGKASSAKQRL<br>KCASLQKFGERAFKAWAVARLSQRFPKAEFAEVSKLVTDLTKVHTECCHGDLLECADDRADLAKYIC<br>ENQDSISSKLKECCEKPLLEKSHCIAEVENDEMPADLPSLAADFVESKDVCKNYAEAKDVFLGMFLY<br>EYARRHPDYSVVLLLRLAKTYETTLEKCCAAADPHECYAKVFDEFKPLVEEPQNLIKQNCELFEQLG<br>EYKFQNALLVRYTKKVPQVSTPTLVEVSRNLGKVGSKCCKHPEAKRMPCAEDYLSVVLNQLCVLHEK<br>TPVSDRVTKCCTESLVNRRPCFSALEVDETYVPKEFNAETFTFHADICTLSEKERQIKKQTALVELV<br>KHKPKATKEQLKAVMDDFAAFVEKCCKADDKETCFAEEGKKLVAASQAALGL | 1655 |

FIGURE 1BH

| | | |
|---|---|---|
| PSIO581 | AEAKYAKEVEEIQMEIFRLPNLNRRQYTAFIRKLLDDPSQSSELLSEAKKLSESQAPKASGGGGSGG GGSDAHKSEVAHRFKDLGEENFKALVLIAFAQYLQQCPFEDHVKLVNEVTEFAKTCVADESAENCDK SLHTLFGDKLCTVATLRETYGEMADCCAKQEPERNECFLQHKDDNPNLPRLVRPEVDVMCTAFHDNE ETFLKKYLYEIARRHPYFYAPELLFFAKRYKAAFTECCQAADKAACLLPKLDELRDEGKASSAKQRL KCASLQKFGERAFKAWAVARLSQRFPKAEFAEVSKLVTDLTKVHTECCHGDLLECADDRADLAKYIC ENQDSISSKLKECCEKPLLEKSHCIAEVENDEMPADLPSLAADFVESKDVCKNYAEAKDVFLGMFLY EYARRHPDYSVVLLLRLAKTYETTLEKCCAAADPHECYAKVFDEFKPLVEEPQNLIKQNCELFEQLG EYKFQNALLIVRYTKKVPQVSTPTLVEVSRNLGKVGSKCCKHPEAKRMPCAEDYLSVVLNQLCVLHEK TPVSDRVTKCCTESLVNRRPCFSALEVDETYVPKEFNAETFTFHADICTLSEKERQIKKQTALVELV KHKPKATKEQLKAVMDDFAAFVEKCCKADDKETCFAEEGKKLVAASQAALGL | 1656 |
| PSIO582 | AEAKYAKEVEEIQMEIFRLPNLTRRQYTAFIRKLLDDPSQSSELLSEAKKLSESQAPKASGGGGSGG GGSVPDKTVRWCAVSEHEATKCQSFRDHMKSVIPSDGPSVACVKKASYLDCIRAIAANEADAVTLDA GLVYDAYLAPNNLKPVVAEFYGSKEDPQTFYYAVAVVKKDSGFQMNQLRGKKSCHTGLGRSAGWNIP IGLLYCDLPEPRKPLEKAVANFFSGSCAPCADGTDFPQLCQLCPGCGCSTLNQYFGYSGAFKCLKDG AGDVAFVKHSTIFENLANKADRDQYELLCLDNTRKPVDEYKDCHLAQVPSHTVVARSMGGKEDLIWE LLNQAQEHFGKDKSKEFQLFSSPHGKDLLFKDSAHGFLKVPPRMDAKMYLGYEYVTAIRNLREGTCP EAPTDECKPVKWCALSHHERLKCDEWSVNSVGKIECVSAETTEDCIAKIMNGEADAMSLDGGFVYIA GKCGLVPVLAENYNKSDNCEDTPEAGYFAIAVVKKSASDLTWDNLKGKKSCHTAVGRTAGWNIPMGL LYNKINHCRFDEFFSEGCAPGSKKDSSLCKLCMGSGLNLCEPNNKEGYYGYTGAFRCLVEKGDVAFV KHQTVPQNTGGKNPDPWAKNLNEKDYELLCLDGTRKPVEEYANCHLARAPNHAVVTRKDKEACVHKI LRQQQHLFGSNVTDCSGNFCLFRSETKDLLFRDDTVCLAKLHDRNTYEKYLGEEYVKAVGNLRKCST SSLLEACTFRRP | 1657 |
| PSIO589 | AEAKYAKEVEEIQMEIFRLPNLTRRQYTAFIRKLLDDPSQSSELLSEAKKLSESQAPKASGGGGSGG GGSDKTHTCPPCPAPELLG | 1658 |
| ABD035 | LAEAKVLANRELDKYGVSDFYKRLINKAKTVEGVEALKLHILAALP | 1659 |
| ABD001 | LAEAKVLANRELDKYGVSDYYKNLINNAKTVEGVKALIDEILAALP | 1660 |
| PP013 | LAEAKEAANAELDSYGVSDFYKRLIDKAKTVEGVEALKDAILAALP | 1661 |

FIGURE 1BI

| hIgG1 Fc | DKTHTCPPCPAPELLGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPGK | 1662 |
|---|---|---|
| hAlbumin | DAHKSEVAHRFKDLGEENFKALVLIAFAQYLQQCPFEDHVKLVNEVTEFAKTCVADESAENCDKSLH TLFGDKLCTVATLRETYGEMADCCAKQEPERNECFLQHKDDNPNLPRLVRPEVDVMCTAFHDNEETF LKKYLYEIARRHPYFYAPELLFFAKRYKAAFTECCQAADKAACLLPKLDELRDEGKASSAKQRLKCA SLQKFGERAFKAWAVARLSQRFPKAEFAEVSKLVTDLTKVHTECCHGDLLECADDRADLAKYICENQ DSISSKLKECCEKPLLEKSHCIAEVENDEMPADLPSLAADFVESKDVCKNYAEAKDVFLGMFLYEYA RRHPDYSVVLLLRLAKTYETTLEKCCAAADPHECYAKVFDEFKPLVEEPQNLIKQNCELFEQLGEYK FQNALLVRYTKKVPQVSTPTLVEVSRNLGKVGSKCCKHPEAKRMPCAEDYLSVVLNQLCVLHEKTPV SDRVTKCCTESLVNRRPCFSALEVDETYVPKEFNAETFTFHADICTLSEKERQIKKQTALVELVKHK PKATKEQLKAVMDDFAAFVEKCCKADDKETCFAEEGKKLVAASQAALGL | 1663 |
| hTransferrin | VPDKTVRWCAVSEHEATKCQSFRDHMKSVIPSDGPSVACVKKASYLDCIRAIAANEADAVTLDAGLV YDAYLAPNNLKPVVAEFYGSKEDPQTFYYAVAVVKKDSGFQMNQLRGKKSCHTGLGRSAGWNIPIGL LYCDLPEPRKPLEKAVANFFSGSCAPCADGTDFPQLCQLCPGCGCSTLNQYFGYSGAFKCLKDGAGD VAFVKHSTIFENLANKADRDQYELLCLDNTRKPVDEYKDCHLAQVPSHTVVARSMGGKEDLIWELLN QAQEHFGKDKSKEFQLFSSPHGKDLLFKDSAHGFLKVPPRMDAKMYLGYEYVTAIRNLREGTCPEAP TDECKPVKWCALSHHERLKCDEWSVNSVGKIECVSAETTEDCIAKIMNGEADAMSLDGGFVYIAGKC GLVPVLAENYNKSDNCEDTPEAGYFAIAVVKKSASDLTWDNLKGKKSCHTAVGRTAGWNIPMGLLYN KINHCRFDEFFSEGCAPGSKKDSSLCKLCMGSGLNLCEPNNKEGYYGYTGAFRCLIVEKGDVAFVKHQ TVPQNTGGKNPDPWAKNLNEKDYELLCLDGTRKPVEEYANCHLARAPNHAVVTRKDKEACVHKILRQ QQHLFGSNVTDCSGNFCLFRSETKDLLFRDDTVCLAKLHDRNTYEKYLGEEYVKAVGNLRKCSTSSL LEACTFRRP | 1664 |

FIGURE 1BJ

| | | |
|---|---|---|
| cIL-1R-I-HIS6 | EADKCNEREEKIILVSSANEIDVRPCPLNPNEYKGTITWYKNDSKTPVSTEQASRIHQHKKKLWFVP AKVEDSGHYYCVVRNSSYCLRIKITAKFVENEPNLCYNAEAIFKQRLPVAGDGGLVCPYMEFFKDEN NELPKLLWYKDCKPLLLDNIHFSGVKDRLIVMNVAEKHRGNYTCHASYTYLGKQYPITRVIEFITLE ENKPTRPVIVSPANETIEVDLGSQIQLICNVTGQLSDTAYWKWNGSFIDEDDPVLGEDYYSVENPAN KRRSTLITVLNISETESRFYKHPFTCLARNTHGMDAAYVQLIYPVTGSENLYFQGSHHHHHH | 1665 |
| cIL-1R-I-Fc | LEADKCNEREEKIILVSSANEIDVRPCPLNPNEYKGTITWYKNDSKTPVSTEQASRIHQHKKKLWFV PAKVEDSGHYYCVVRNSSYCLRIKITAKFVENEPNLCYNAEAIFKQRLPVAGDGGLVCPYMEFFKDE NNELPKLLWYKDCKPLLLDNIHFSGVKDRLIVMNVAEKHRGNYTCHASYTYLGKQYPITRVIEFITL EENKPTRPVIVSPANETIEVDLGSQIQLICNVTGQLSDTAYWKWNGSFIDEDDPVLGEDYYSVENPA NKRRSTLITVLNISETESRFYKHPFTCLARNTHGMDAAYVQLIYPVTGSENLYFQGSDKTHTCPPCP APELLGGPSVFLFPPKPKDTLMISRTPEVTCVVVDVSHEDPEVKFNWYVDGVEVHNAKTKPREEQYN STYRVVSVLTVLHQDWLNGKEYKCKVSNKALPAPIEKTISKAKGQPREPQVYTLPPSRDELTKNQVS LTCLVKGFYPSDIAVEWESNGQPENNYKTTPPVLDSDGSFFLYSKLTVDKSRWQQGNVFSCSVMHEA LHNHYTQKSLSLSPGK | 1666 |
| mut1 | AEAKYAKEAHRAQMEIFALPNLTRRQYTAFIRKLLDDPSQSSELLSEAKKLSESQAPK | 1667 |
| mut2 | AEAKYAKEALSAQQEIFALPNLTRRQYTAFIRKLLDDPSQSSELLSEAKKLSESQAPK | 1668 |
| mut3 | KYAKEAHRAQMEIFALPNLTRRQYTAFIRKLLDDPSQSSELLSEAKKLSESQAPK | 1669 |
| mut4 | AEAKYAKEIEEVQMEIFYLPNLTRRQYTAFIRKLLDDPSQSSELLSEAKKLSESQAPK | 1670 |
| mut5 | AEAKYAKEIEEIQMEIFHLPNLTRRQYTAFIRKLLDDPSQSSELLSEAKKLSESQAPK | 1671 |
| mut6 | AEAKYAKEVEEIQMEIFRLPNLTRRQYTAFIRKLLDDPSQSSELLSEAKKLSESQAPK | 1672 |
| mut7 | AEAKYAKEVEDIQLEIFALPNLTRRQYTAFIRKLLDDPSQSSELLSEAKKLSESQAPK | 1673 |
| mut8 | AEAKYAKELEAIQMEIFHLPNLTRRQYTAFIRKLLDDPSQSSELLSEAKKLSESQAPK | 1674 |
| mut9 | AEAKYAKETEAVQMEIFALPNLTRRQYTAFIRKLLDDPSQSSELLSEAKKLSESQAPK | 1675 |
| mut10 | AEAKYAKEIEEIQMEIFRLPNLTRRQYTAFIRKLLDDPSQSSELLSEAKKLSESQAPK | 1676 |
| mut11 | AEAKYAKELEAIQMEIFYLPNLTRRQVAFIRKLLDDPSQSSELLSEAKKLSESQAPK | 1677 |
| mut12 | AEAKYAKELEEIQMEIFYLPNLTRRQYTAFIRKLLDDPSQSSELLSEAKKLSESQAPK | 1678 |
| mut13 | AEAKYAKEVEEIQMEIFRLPNLNRRQYTAFIRKLLDDPSQSSELLSEAKKLSESQAPK | 1679 |

FIGURE 1BK

| | | |
|---|---|---|
| GS-hIL-1B | GSAPVRSLNCTLRDSQQKSLVMSGPYELKALHLQGQDMEQQVVFSMSFVQGEESNDKIPVALGLKEK NLYLSCVLKDDKPTLQLESVDPKNYPKKKMEKRFVFNKIEINNKLEFESAQFPNWYISTSQAENMPV FLGGTKGGQDITDFTMQFVSS | 1733 |
| PSI0653 | AEAKYAKEVEEIQMEIFRLPNLTRRQYTAFIRKLLDDPSQSSELLSEAKKLSESQAPKASGGGGSGGGGSDKTHTCP PCPAPELLGGPSVFLFPPKPKDTLMISRTPEVTCVVVDVSHEDPEVKFNWYVDGVEVHNAKTKPREEQYASTYRV VSVLTVLHQDWLNGKEYKCKVSNKALPAPIEKTISKAKGQPREPQVYTLPPSRDELTKNQVSLTCLVKGFYPSDIAV EWESNGQPENNYKTTPPVLDSDGSFFLYSKLTVDKSRWQQGNVFSCSVMHEALHNHYTQKSLSLSPGK | 1734 |
| PSI0654 | AEAKYAKEVEEIQMEIFRLPNLTRRQYTAFIRKLLDDPSQSSELLSEAKKLSESQAPKASGGGGSGGGGSDKTHTCP PCPAPELLGGPSVFLFPPKPKDTLMISRTPEVTCVVVDVSHEDPEVKFNWYVDGVEVHNAKTKPREEQYASTYRV VSVLTVLHQDWLNGKEYKCKVSNKALPAPIEKTISKAKGQPREPQVYTLPPSRDELTKNQVSLTCLVKGFYPSDIAV EWESNGQPENNYKTTPPVLDSDGSFFLYSKLTVDKSRWQQGNVFSCSVLHEALHSHYTQKSLSLSPGK | 1735 |
| PSI0655 | AEAKYAKEVEEIQMEIFRLPNLTRRQYTAFIRKLLDDPSQSSELLSEAKKLSESQAPKASGGGGSGGGGSDKTHTCP PCPAPELLGGPSVFLFPPKPKDTLYITREPEVTCVVVDVSHEDPEVKFNWYVDGVEVHNAKTKPREEQYASTYRVV SVLTVLHQDWLNGKEYKCKVSNKALPAPIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVMHEALHNHYTQKSLSLSPGK | 1736 |
| PSI0656 | AEAKYAKEVEEIQMEIFRLPNLTRRQYTAFIRKLLDDPSQSSELLSEAKKLSESQAPKASGGGGSGGGGSESKYGPPC PPCPAPEFLGGPSVFLFPPKPKDTLMISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVYTLPPSQEEMTKNQVSLTCLVKGFYPSDIA VEWESNGQPENNYKTTPPVLDSDGSFFLYSRLTVDKSRWQEGNVFSCSVMHEALHNHYTQKSLSLSLGK | 1737 |

IL-IR-I BINDING POLYPEPTIDE

CROSS REFERENCE TO RELATED APPLICATION(S)

This Application is a National Stage filing under 35 U.S.C. 371 of International Patent Application No. PCT/EP2018/058448, filed Apr. 3, 2018, which claims priority to European Application Number 17164226.7, filed Mar. 31, 2017. The entire contents of these applications are incorporated herein by reference in their entirety.

FIELD OF THE INVENTION

The present disclosure relates to a class of engineered polypeptides having a binding affinity for interleukin-1 receptor type-I (in the following referred to as IL-1R-1). The present disclosure also relates to the use of such an IL-1R-I binding polypeptide as a therapeutic, prognostic and/or diagnostic agent.

Background

The central role of the IL-1 system in the initiation and maintenance of inflammatory response, as well as its role in innate and adaptive branches of the immune system, makes it an attractive target for pharmaceutical intervention (Dinarello, 2009, Annu Rev Immunol, 27:519-50; Sims and Smith, 2010, Nat Rev Immunol. 10(2):89-102). Since the IL-1 system in many cases plays the role of initiator and master cytokine in inflammatory response, many aspects of the progression of a pathological immune response can be modulated by such intervention. The biological activity of IL-1p can be pharmacologically inhibited by antibodies that prevent, or modulate its binding to the type IL-1 receptor IL-1R-1.

The biological activity of the IL-1 system can also be modulated by antagonizing the IL-1R. The recombinant form of endogenous IL-1 Ra denoted anakinra (Kineret®) is described in e.g. U.S. Pat. No. 6,599,873, EP 0343684 and EP 0541920. Anakinra has shown clinical efficacy in rheumatoid arthritis, cryopyrin-associated periodic syndromes (CAPS; Koné-Paut and Galeotti, 2014, Expert Rev Clin Immunol, 10(1):7-18), as well as in a large number of other inflammatory and autoimmune conditions (Dinarello et al, 2011, Blood, 117(14):3720-32; Dinarello et al, 2012, Nat Rev Drug Discov, 11(8):633-52)).

The IL-1 receptor can also be antagonized by antibodies that bind to IL-1R-I subunit and prevent ligand-mediated IL-1 receptor activation and signaling. Several such antibodies are described in WO 2004/022718, which discloses IL-1R-I antagonists such as 15C4. Other examples of IL-1 receptor antagonizing antibodies binding to the IL-1R-I subunit are described in WO 2010/052505, which discloses IL-1R-I antagonists such as Antibody 9GL. Yet another example of an IL-1 receptor antagonizing antibody, denoted 2D8 is described in WO 2005/023872.

The unpredictable and chronic nature of inflammatory diseases, as well as a high unmet medical need, warrants the development of new modes of treatment. Since tissue penetration rate is negatively associated with the size of the molecule, relatively large antibody molecules inherently have poor tissue distribution and penetration capacity.

Thus, the use of antibodies, or other large molecule drugs, is not always optimal for therapy and there is continued need for provision of agents with a high affinity for the IL-1 receptor.

SUMMARY OF THE INVENTION

It is an object of the present disclosure to provide new IL-1R-I binding agents, which could for example be used for therapeutic, prognostic and diagnostic applications.

It is an object of the present disclosure to provide a molecule allowing for efficient therapy targeting various forms of inflammatory, autoinflammatory and autoimmune diseases.

It is furthermore an object of the present disclosure to provide a molecule suitable for prognostic and diagnostic applications.

These and other objects, which are evident to the skilled person from the present disclosure, are met by different aspects of the invention as claimed in the appended claims and as generally disclosed herein.

Thus, in the first aspect of the disclosure, there is provided an IL-1R-I binding polypeptide, comprising an IL-1R-I binding motif BM, which motif consists of an amino acid sequence selected from:

i)

$$EX_2X_3X_4X_5X_6X_7EIX_{10}X_{11}LPNLX_{16}RX_{18}QYX_{21}AFIX_{25}X_{26}LX_{28}D$$
(SEQ ID NO: 1686)

wherein, independently from each other,
- $X_2$ is selected from A, D, E, F, H, I, L, Q, S, T and V;
- $X_3$ is selected from A, D, E, F, H, I, K, L, N, Q, R, S, T, V, W and Y;
- $X_4$ is selected from A, D, E, F, H, I, K, L, M, N, Q, R, S, T, V, W and Y;
- $X_5$ is selected from A, I and V;
- $X_6$ is selected from F, H, I, Q, R, T, V and Y;
- $X_7$ is selected from A, D, E, F, G, H, I, L, M, Q, S, T, V, W and Y;
- $X_{10}$ is selected from F and Y;
- $X_{11}$ is selected from A, D, E, F, G, H, I, K, L, M, N, Q, R, S, T, V, W and Y;
- $X_{16}$ is selected from N and T;
- $X_{18}$ is selected from K, R and S;
- $X_{21}$ is selected from Q, T and V;
- $X_{25}$ is selected from I, M, R, V and Y;
- $X_{26}$ is selected from K and S, and
- $X_{28}$ is selected from F, I, L and M, and ii) an amino acid sequence which has at least 96% identity to the sequence defined in i) provided that $X_5$ is I or V.

The above definition of a class of sequence related, IL-1R-I binding polypeptides is based on a statistical analysis of a number of random polypeptide variants of a parent scaffold, that were selected for their interaction with IL-1R-I in several different selection experiments. The identified IL-1R-I binding motif, or "BM", corresponds to the target binding region of the parent scaffold, which region constitutes two alpha helices within a three-helical bundle protein domain. In the parent scaffold, the varied amino acid residues of the two BM helices constitute a binding surface for interaction with the constant Fc part of antibodies. In the present disclosure, the random variation of binding surface residues and subsequent selection of variants have replaced the Fc interaction capacity with a capacity for interaction with IL-1R-I.

As the skilled person will realize, the function of any polypeptide, such as the IL-1R-I binding capacity of the polypeptide of the present disclosure, is dependent on the tertiary structure of the polypeptide. It is therefore possible to make minor changes to the sequence of amino acids in a polypeptide without affecting the function thereof. Thus, the disclosure encompasses modified variants of the IL-1R-I binding polypeptide, which have retained IL-1R-I binding characteristics.

In this way, also encompassed by the present disclosure is an IL-1R-I binding polypeptide comprising an amino acid sequence with 96% or greater identity to a polypeptide as defined in i). Thus, certain sequence variants of the sequence defined in i) are encompassed by the above definition under the proviso that within such sequence variants $X_5$ is I or V. For example, it is possible that an amino acid residue belonging to a certain functional grouping of amino acid residues (e.g. hydrophobic, hydrophilic, polar etc) could be exchanged for another amino acid residue from the same functional group.

In some embodiments, such changes may be made in any position of the sequence of the IL-1R-I binding polypeptide as disclosed herein. In other embodiments, such changes may be made only in the non-variable positions, also denoted scaffold amino acid residues. In such cases, changes are not allowed in the variable positions, i.e. positions denoted with an "X" in sequence i).

The term "% identity", as used throughout the specification, may for example be calculated as follows. The query sequence is aligned to the target sequence using the CLUSTAL W algorithm (Thompson et al, 1994, Nucleic Acids Research, 22: 4673-4680). A comparison is made over the window corresponding to the shortest of the aligned sequences. The shortest of the aligned sequences may in some instances be the target sequence. In other instances, the query sequence may constitute the shortest of the aligned sequences. The amino acid residues at each position are compared and the percentage of positions in the query sequence that have identical correspondences in the target sequence is reported as % identity. As used herein "$X_a$" and "$X_m$" are used to indicate amino acids in positions n and m in the sequence i) as defined above, wherein n and m are integers which indicate the position of an amino acid within said sequence as counted from the N-terminal end of said sequence. For example, $X_3$ and $X_7$ indicate the amino acid in position three and seven, respectively, from the N-terminal end of sequence i).

In embodiments according to the first aspect, there are provided polypeptides wherein $X_n$ in sequence i) is independently selected from a group of possible residues according to Table 1. The skilled person will appreciate that $X_n$ may be selected from any one of the listed groups of possible residues and that this selection is independent from the selection of amino acids in $X_m$, wherein n≠m. Thus, any of the listed possible residues in position $X_n$ in Table 1 may be independently combined with any of the listed possible residues in any other variable position in Table 1.

The skilled person will appreciate that Table 1 is to be read as follows: In one embodiment according to the first aspect, there is provided a polypeptide wherein amino acid residue "$X_n$" in sequence i) is selected from "Possible residues". Thus, Table 1 discloses several specific and individualized embodiments of the first aspect of the present disclosure. For example, in one embodiment according to the first aspect, there is provided a polypeptide wherein $X_4$ in sequence i) is selected from A, D, E, I, K, O, S and V, and in another embodiment according to the first aspect, there is provided a polypeptide wherein $X_4$ in sequence i) is selected from A, E, I, K, Q and V. For avoidance of doubt, the listed embodiments may be freely combined in yet other embodiments. For example, one such combined embodiment is a polypeptide in which $X_4$ is selected from A, E, I, K, Q and V, while $X_6$ is selected from H, Q, T and Y, and $X_1$ is selected from H, R and Y.

TABLE 1

Embodiments of the first aspect of the present disclosure

| Residue $X_n$ | Possible residues |
|---|---|
| $X_2$ | A, E, F, H, I, L, Q, S, T, V |
| $X_2$ | A, F, H, I, L, Q, S, T, V |
| $X_2$ | A, H, I, L, Q, S, T, V |
| $X_2$ | A, H, I, L, Q, T, V |
| $X_2$ | A, H, I, L, T, V |
| $X_2$ | A, F, I, L, T, V |
| $X_2$ | A, I, L, T, V |
| $X_2$ | A, I, T, V |
| $X_2$ | A, I, L, T |
| $X_2$ | A, L, T, V |
| $X_2$ | A, I, L, V |
| $X_2$ | I, L, T, V |
| $X_2$ | A, I, T |
| $X_2$ | A, I, V |
| $X_2$ | A, T, V |
| $X_2$ | I, T, V |
| $X_2$ | I, L, T |
| $X_2$ | I, L, V |
| $X_2$ | L, T, V |
| $X_2$ | I, V |
| $X_2$ | I, L |
| $X_2$ | I, T |
| $X_2$ | I, V |
| $X_2$ | L, T |
| $X_2$ | L, V |
| $X_2$ | T, V |
| $X_2$ | A, I |
| $X_2$ | A, T |
| $X_2$ | A, V |
| $X_2$ | L |
| $X_2$ | T |
| $X_2$ | V |
| $X_2$ | I |
| $X_2$ | A |
| $X_3$ | A, D, E, F, H, I, K, L, Q, R, S, T, V, W, Y |
| $X_3$ | A, D, E, F, H, I, K, L, N, Q, R, S, T, V, Y |
| $X_3$ | A, D, E, H, I, K, L, N, Q, R, S, T, V, Y |
| $X_3$ | A, D, E, F, H, I, K, Q, R, S, T, V, Y |
| $X_3$ | A, D, E, F, H, I, K, Q, R, V, Y |
| $X_3$ | D, E, H, I, K, L, Q, T, V, Y |
| $X_3$ | D, E, H, I, K, Q, T, V, Y |
| $X_3$ | D, E, H, I, K, Q, R, S, V, Y |
| $X_3$ | D, E, H, I, K, Q, S, V, Y |
| $X_3$ | D, E, H, I, K, Q, R, V, Y |
| $X_3$ | D, E, I, K, Q, R, V, Y |
| $X_3$ | D, E, H, I, K, Q, V, Y |
| $X_3$ | D, E, H, I, Q, V, Y |
| $X_3$ | D, E, I, Q, R, V, Y |
| $X_3$ | D, E, I, Q, V, Y |
| $X_3$ | D, E, H, Q, Y |
| $X_3$ | D, E, Q, V, Y |
| $X_3$ | D, E, V, Y |
| $X_3$ | D, E, R, V |
| $X_3$ | D, E, K, V |
| $X_3$ | E, I, V, Y |
| $X_3$ | E, V, Y |
| $X_3$ | D, E, V |
| $X_3$ | D, E, Y |
| $X_3$ | E, V |
| $X_3$ | D, E |

TABLE 1-continued

Embodiments of the first aspect of the present disclosure

| Residue $X_n$ | Possible residues |
|---|---|
| $X_3$ | E, Y |
| $X_3$ | E, I |
| $X_3$ | E, K |
| $X_3$ | E |
| $X_4$ | A, D, E, F, H, I, K, L, N, Q, R, S, T, V, W, Y |
| $X_4$ | A, D, E, F, H, I, K, L, N, Q, R, S, T, V, Y |
| $X_4$ | A, D, E, F, H, I, K, L, Q, R, S, T, V, W, Y |
| $X_4$ | A, D, E, F, H, I, K, Q, R, S, T, V, W, Y |
| $X_4$ | A, D, E, F, H, K, L, Q, R, S, T, V, W, Y |
| $X_4$ | A, D, E, H, I, K, L, Q, R, S, T, V, W, Y |
| $X_4$ | A, D, E, H, I, K, L, N, Q, R, S, T, V, Y |
| $X_4$ | A, D, E, I, K, Q, R, S, T, V |
| $X_4$ | A, D, E, I, K, Q, T, V |
| $X_4$ | A, D, E, H, I, K, N, Q, R, S, T, V, Y |
| $X_4$ | A, D, E, H, I, K, Q, R, S, T, V, W, Y |
| $X_4$ | A, D, E, I, K, Q, R, S, T, V |
| $X_4$ | A, E, I, K, Q, R, T, V, Y |
| $X_4$ | A, D, E, H, I, K, Q, R, S, T, V |
| $X_4$ | A, D, E, H, I, K, R, S, V |
| $X_4$ | A, D, E, H, K Q V, W |
| $X_4$ | A, D, E, H, I, R, S, T, V |
| $X_4$ | A, D, E, I, K, Q, S, V |
| $X_4$ | A, D, E, I, Q, R, V |
| $X_4$ | A, D, E, K, Q, S, T, V |
| $X_4$ | A, D, E, I, Q, V |
| $X_4$ | A, D, E, K, Q, V |
| $X_4$ | A, E, I, K, Q, V |
| $X_4$ | A, E, H, K, Q, V |
| $X_4$ | A, D, E, I, V |
| $X_4$ | A, D, E, I, R |
| $X_4$ | D, E R, T, V |
| $X_4$ | A, D, E, K, Q |
| $X_4$ | A, D, E, Q, V |
| $X_4$ | A, D, E, K, V |
| $X_4$ | A, E, Q, V |
| $X_4$ | A, E, I, R |
| $X_4$ | A, D, E, I |
| $X_4$ | A, D, E, Q |
| $X_4$ | A, D, E, V |
| $X_4$ | A, D, E, K |
| $X_4$ | A, E, K, V |
| $X_4$ | A, D, E |
| $X_4$ | A, E, V |
| $X_4$ | A, D |
| $X_4$ | A, E |
| $X_4$ | D, E |
| $X_4$ | E, V |
| $X_4$ | E |
| $X_4$ | D |
| $X_4$ | A |
| $X_4$ | V |
| $X_5$ | A, V |
| $X_5$ | I, V |
| $X_5$ | A, I |
| $X_5$ | A |
| $X_5$ | I |
| $X_5$ | V |
| $X_6$ | F, H, Q, R, V, Y |
| $X_6$ | H, Q, T, Y |
| $X_6$ | F, H, Q, Y |
| $X_6$ | A, H, Q, W, Y |
| $X_6$ | H, Q, Y |
| $X_6$ | Q, Y |
| $X_6$ | Y |
| $X_6$ | Q |
| $X_7$ | A, D, E, F, H, I, L, M, Q, S, V, W, Y |
| $X_7$ | A, D, E, F, H, L, M, Q, R, W, Y |
| $X_7$ | A, D, E, F, H, I, L, M, Q, W, Y |
| $X_7$ | D, E, F, H, L, M, Q, W, Y |
| $X_7$ | D, F, H, L, M, Q, W, Y |
| $X_7$ | F, H, I, L, M, Q, V, W, Y |
| $X_7$ | F, H, I, L, M, Q, V, Y |
| $X_7$ | D, F, H, L, M, Q, W, Y |
| $X_7$ | F, H, I, L, M, Q, Y |
| $X_7$ | F, L, M, Q, W, Y |
| $X_7$ | F, M, Q, W, Y |
| $X_7$ | F, L, M, W, Y |
| $X_7$ | F, I, L, M, Y |
| $X_7$ | F, H, M, W, Y |
| $X_7$ | F, L, M, Y |
| $X_7$ | F, M, W, Y |
| $X_7$ | F, L, M, W |
| $X_7$ | D, F, H, M |
| $X_7$ | D, F, M |
| $X_7$ | F, M, Y |
| $X_7$ | M, W, Y |
| $X_7$ | F, M, W |
| $X_7$ | F, L, M |
| $X_7$ | L, M, Y |
| $X_7$ | F, L, Y |
| $X_7$ | F, M |
| $X_7$ | L, M |
| $X_7$ | M, Y |
| $X_7$ | F, L |
| $X_7$ | L, Y |
| $X_7$ | F, Y |
| $X_7$ | F, W |
| $X_7$ | M, W |
| $X_7$ | L |
| $X_7$ | Y |
| $X_7$ | F |
| $X_7$ | M |
| $X_7$ | W |
| $X_{10}$ | F |
| $X_{10}$ | Y |
| $X_{11}$ | A, D, E, F, G, H, I, K, L, N, Q, R, S, T, V, Y |
| $X_{11}$ | A, D, E, F, G, H, K, L, N, Q, R, S, T, V, W, Y |
| $X_{11}$ | A, D, E, F, G, H, I, K, N, Q, R, S, T, V, Y |
| $X_{11}$ | A, D, E, F, G, H, K, L, N, Q, R, S, T, V, Y |
| $X_{11}$ | A, D, E, F, G, H, K, L, Q, R, S, T, V, W, Y |
| $X_{11}$ | A, D, E, F, G, H, K, L, N, Q, R, S, Y |
| $X_{11}$ | A, D, E, F, G, H, K, L, Q, R, S, T, V, Y |
| $X_{11}$ | A, D, E, F, G, H, K, L, Q, R, S, T Y |
| $X_{11}$ | A, D, E, F, G, H, K, L, N, Q, R, S, T, Y |
| $X_{11}$ | A, D, E, F, G, H, K, N, Q, R, S, T, V, Y |
| $X_{11}$ | A, D, E, F, G, H, K, N, Q, R, S, V, Y |
| $X_{11}$ | A, D, E, F, G, H, K, Q, R, S, V, W, Y |
| $X_{11}$ | A, D, E, F, G, H, K, Q, R, S, V, Y |
| $X_{11}$ | A, D, E, G, H, K, N, Q, R, S, Y |

TABLE 1-continued

Embodiments of the first aspect of the present disclosure

| Residue $X_n$ | Possible residues |
|---|---|
| $X_{11}$ | A, D, E, F, G, H, I, L, M, Q, S, T, V, W, Y |
| $X_{11}$ | A, D, E, G, K, N, Q, R, S, T, Y |
| $X_{11}$ | A, D, E, F, G, H, Q, R, S, Y |
| $X_{11}$ | A, D, E, G, H, Q, S, Y |
| $X_{11}$ | A, D, E, F, G, H, K, Q, R, S, Y |
| $X_{11}$ | A, D, G, H, K, Q, R, S, Y |
| $X_{11}$ | A, E, G, H, K, N, Q, R, S, Y |
| $X_{11}$ | A, E, G, H, K, N, R, S, Y |
| $X_{11}$ | A, E, G, H, K, N, S, Y |
| $X_{11}$ | A, E, G, H, N, R, S, Y |
| $X_{11}$ | A, D, G, H, K, Q, R, S |
| $X_{11}$ | A, D, G, H, Q, R, S, Y |
| $X_{11}$ | A, E, G, H, R, S, Y |
| $X_{11}$ | A, D, G, H, Q, R, S |
| $X_{11}$ | A, G, H, Q, R, S, Y |
| $X_{11}$ | A, G, H, Q, R, S |
| $X_{11}$ | A, E, G, H, S, Y |
| $X_{11}$ | A, E, G, N, S, Y |
| $X_{11}$ | A, H, R, S, Y |
| $X_{11}$ | A, D, G, H, S, Y |
| $X_{11}$ | A, D, G, H, R, Y |
| $X_{11}$ | A, E, N, R, Y |
| $X_{11}$ | A, E, G, H, Y |
| $X_{11}$ | A, G, H, S, Y |
| $X_{11}$ | A, E, G, S, Y |
| $X_{11}$ | A, E, G, H, S |
| $X_{11}$ | A, E, H, R, Y |
| $X_{11}$ | A, G, H, R, Y |
| $X_{11}$ | A, H, R, S, Y |
| $X_{11}$ | A, E, G, N, S |
| $X_{11}$ | A, H, N, R, Y |
| $X_{11}$ | A, D, G, H |
| $X_{11}$ | A, G, S, Y |
| $X_{11}$ | A, G, H, Y |
| $X_{11}$ | A, G, H, S |
| $X_{11}$ | A, E, G, Y |
| $X_{11}$ | A, E, G, S |
| $X_{11}$ | A, E, G, H |
| $X_{11}$ | A, H, R, Y |
| $X_{11}$ | G, H, R, Y |
| $X_{11}$ | A, G, R, Y |
| $X_{11}$ | A, G, H, Y |
| $X_{11}$ | A, G, H, R |
| $X_{11}$ | A, E, G, N |
| $X_{11}$ | A, E, G, S |
| $X_{11}$ | A, E, G |
| $X_{11}$ | A, G, H |
| $X_{11}$ | A, G, S |
| $X_{11}$ | A, G, Y |
| $X_{11}$ | A, H, R |
| $X_{11}$ | A, R, Y |
| $X_{11}$ | A, H, Y |
| $X_{11}$ | H, R, Y |
| $X_{11}$ | A, G |
| $X_{11}$ | A, H |
| $X_{11}$ | A, R |
| $X_{11}$ | A, Y |
| $X_{11}$ | H, R |
| $X_{11}$ | H, Y |
| $X_{11}$ | R, Y |
| $X_{11}$ | A, E |
| $X_{11}$ | A, |
| $X_{11}$ | G |
| $X_{11}$ | R |
| $X_{11}$ | Y |
| $X_{11}$ | H |
| $X_{11}$ | E |
| $X_{16}$ | N |
| $X_{16}$ | T |
| $X_{18}$ | K, R |
| $X_{18}$ | R |
| $X_{18}$ | K |
| $X_{21}$ | T, V |
| $X_{21}$ | T |
| $X_{21}$ | V |
| $X_{25}$ | I, M, R |
| $X_{25}$ | I, R |
| $X_{25}$ | R |
| $X_{25}$ | I |
| $X_{26}$ | K |
| $X_{26}$ | S |
| $X_{28}$ | F, I, L |
| $X_{28}$ | F, L |
| $X_{28}$ | F |
| $X_{28}$ | L |

In one embodiment of the present disclosure there is provided an IL-1R-I binding polypeptide, wherein in i)

$X_2$ is selected from A, E, F, H, I, L, Q, S, T and V;
$X_3$ is selected from A, D, E, F, H, I, K, L, N, Q, R, S, T, V, W and Y;
$X_4$ is selected from A, D, E, F, H, I, K, L, M, N, Q, R, S, T, V, W and Y;
$X_5$ is selected from A, I and V;
$X_6$ is selected from F, H, Q, R, V and Y;
$X_7$ is selected from A, D, E, F, G, H, I, L, M, Q, S, T, V, W and Y;
$X_{10}$ is selected from F and Y;
$X_{11}$ is selected from A, D, E, F, G, H, I, L, M, Q, S, T, V, W and Y;
$X_{16}$ is selected from N and T;
$X_{18}$ is selected from K and R;
$X_{21}$ is selected from T and V;
$X_{25}$ is selected from I and R;
$X_{26}$ is selected from K and S, and
$X_{28}$ is selected from F and L.

In one embodiment of the present disclosure there is provided an IL-1R-I binding polypeptide, wherein in i)

$X_2$ is selected from A, E, F, H, I, L, Q, S, T and V;
$X_3$ is selected from A, D, E, F, H, I, K, L, Q, R, S, T, V, W and Y;
$X_4$ is selected from A, D, E, F, H, I, K, L, N, Q, R, S, T, V, W and Y;
$X_5$ is selected from A, I and V;
$X_6$ is selected from H, Q, R, and Y;
$X_7$ is selected from A, D, E, F, G, H, I, L, M, Q, S, V, W and Y;
$X_{10}$ is selected from F and Y;
$X_{11}$ is selected from A, D, E, F, G, H, I, K, L, N, Q, R, S, T, V, W and Y;
$X_{16}$ is selected from N and T;
$X_{18}$ is selected from K and R;
$X_{21}$ is selected from T and V;
$X_{25}$ is selected from I and R;
$X_{26}$ is selected from K and S, and
$X_{28}$ is selected from F and L.

In one embodiment of the present disclosure there is provided an IL-1R-I binding polypeptide, wherein in i)

$X_2$ is selected from A, I, L, T and V;
$X_3$ is selected from E, I, V and Y;
$X_4$ is selected from A, D, E, F, H, I, K, L, Q, R, S, T, V, W and Y;
$X_5$ is selected from A, I and V;

$X_6$ is selected from Q and Y;
$X_7$ is selected from F, H, I, L, M, Q, V, W and Y;
$X_{10}$ is selected from F and Y;
$X_{11}$ is selected from A, D, E, F, G, H, K, L, Q, R, S, T, V, W and Y;
$X_{16}$ is selected from N and T;
$X_{18}$ is selected from K and R;
$X_{21}$ is selected from T and V;
$X_{25}$ is selected from I and R;
$X_{26}$ is selected from K and S, and
$X_{28}$ is selected from F and L.

In another embodiment of the present disclosure there is provided an IL-1R-I binding polypeptide, wherein said IL-1R-I binding motif consists of an amino acid sequence selected from a sequence wherein in i)
$X_2$ is selected from A, I, L, T and V;
$X_3$ is selected from E and Y;
$X_4$ is selected from A, E, I, K, Q, R, T, V and Y;
$X_5$ is selected from I and V;
$X_6$ is selected from Q and Y;
$X_7$ is selected from F and M;
$X_{10}$ is selected from F and Y;
$X_{11}$ is selected from A, D, E, F, G, H, K, L, Q, R, S, T, V and Y;
$X_{16}$ is selected from N and T;
$X_{18}$ is selected from K and R;
$X_{21}$ is selected from T and V;
$X_{25}$ is selected from I and R;
$X_{26}$ is selected from K and S, and
$X_{28}$ is selected from F and L,
and an amino acid sequence which has at least 93% identity to the sequence defined above.

In another embodiment of the present disclosure there is provided an IL-1R-I binding polypeptide, wherein in i)
$X_2$ is selected from A, I, L, T and V;
$X_3$ is selected from E and Y;
$X_4$ is selected from A, D, E, F, H, K, L, Q, R, S, T, V, W and Y;
$X_5$ is selected from A, I and V;
$X_6$ is selected from Q and Y;
$X_7$ is selected from F, H, I, L, M, Q, V, W and Y, such as F, H, I, L, Q, V, W and Y;
$X_{10}$ is selected from F and Y;
$X_{11}$ is selected from A, D, E, F, G, H, K, Q, R, S, V, W and Y;
$X_{16}$ is selected from N and T;
$X_{18}$ is selected from K and R;
$X_{21}$ is T;
$X_{25}$ is selected from I and R;
$X_{26}$ is selected from K and S, and
$X_{28}$ is selected from F and L.

In a more specific embodiment defining a sub-class of IL-1R-I binding polypeptides, sequence i) fulfills at least five of the ten conditions I-X:
I. $X_3$ is E;
II. $X_5$ is selected from I and V;
III. $X_6$ is selected from Q and Y;
IV. $X_7$ is selected from F and M;
V. $X_{10}$ is selected from F and Y;
VI. $X_{18}$ is selected from K and R;
VII. $X_{21}$ is T;
VIII. $X_{25}$ is R;
IX. $X_{26}$ is selected from K and S; and
X. $X_{28}$ is selected from F and L.

In some examples of an IL-1R-I binding polypeptide according to the first aspect, sequence i) fulfils at least six of the ten conditions I-X. More specifically, sequence i) may fulfil at least seven of the ten conditions I-X, such as at least eight of the ten conditions I-X, such as at least nine of the ten conditions I-X, such as all of the ten conditions I-X.

In some embodiments of an IL-1R-I binding polypeptide according to the first aspect, there is provided an IL-1R-I binding polypeptide, wherein $X_2X_3X_6$ is VEQ or VEY. In some embodiments there is provided an IL-1R-I binding polypeptide, wherein $X_2X_3X_6$ is IEQ or VEQ. In some embodiments $X_6X_{10}$ is selected from the group consisting of QF, QY, YF and YY. In some embodiments $X_6X_{10}$ is QF. In some embodiments $X_{10}X_{18}$ is selected from the group consisting of FK, FR, YK and YR. In some embodiments $X_{10}X_{18}$ is FK or FR. In some embodiments $X_{18}X_{25}X_{28}$ is KRL or RRL. In some embodiments $X_5X_7$ is AM, IM or VM. In some embodiments $X_5X_7$ is IM or VM.

In one embodiment, $X_5$ is selected from I and V. As demonstrated in the appended Example 4, the unintentional alteration in position $X_5$ of the BM resulted in the finding of an IL-1R-I binding polypeptide (Z18557, SEQ ID NO:1205) displaying high affinity for IL-1R-I (see Table 11). The exchange of alanine in this position to valine or isoleucine allows for generation of IL-1R-I binding polypeptides with high affinity for IL-1R-I.

As described in detail in the experimental section to follow, the selection of IL-1R-I binding polypeptide variants has led to the identification of a number of individual IL-1R-I binding motif (BM) sequences. These sequences constitute individual embodiments of sequence i) according to this aspect. The sequences of individual IL-1R-I binding motifs correspond to amino acid positions 8-36 of the amino acid sequences listed as SEQ ID NOs 1-1632 and 1679 presented in FIG. 1. Thus, in one embodiment, of the IL-1R-I binding polypeptide according to this aspect, sequence i) corresponds to the sequence from position 8 to position 36 in a sequence selected from the group consisting of SEQ ID NO:1-1632 and 1679, such as the group consisting SEQ ID NO:20-1632, and 1679. In one embodiment sequence i) corresponds to the sequence from position 8 to position 36 in a sequence selected from the group consisting of SEQ ID NO:1206-1632 and 1679, such as the group consisting of SEQ ID NO:1210-1632 and 1679.

In one embodiment sequence i) corresponds to the sequence from position 8 to position 36 in a sequence selected from the group consisting of SEQ ID NO:1205 and 1250-1632.

In one embodiment sequence i) corresponds to the sequence from position 8 to position 36 in a sequence selected from the group consisting of SEQ ID NO:1206-1252 and 1679.

In another embodiment sequence i) corresponds to the sequence from position 8 to position 36 in a sequence selected from the group consisting of SEQ ID NO:1253-1632. In another embodiment sequence i) corresponds to the sequence from position 8 to position 36 in a sequence selected from the group consisting of SEQ ID NO:1253-1441 or the group consisting of SEQ ID NO:1442-1632.

In one embodiment, sequence i) corresponds to the sequence from position 8 to position 36 in a sequence selected from the group consisting of SEQ ID NO:158, 227, 268, 294, 325, 1176, 1205, 1251, 1252, 1270, 1284, 1285, 1298, 1307, 1308, 1311, 1324, 1328, 1330, 1331, 1334, 1339, 1340, 1343, 1353, 1361, 1362, 1364, 1367, 1368, 1375, 1393, 1415, 1420, 1421, 1422, 1423, 1435, 1471, 1472, 1571, 1594 and 1662, such as from the group consisting of SEQ ID NO:268, 1205, 1252, 1270, 1284, 1285, 1298, 1307, 1308, 1324, 1328, 1330, 1331, 1334, 1339, 1340, 1343, 1361, 1364, 1367, 1368, 1375, 1393, 1415, 1420, 1421, 1422, 1423 and 1571, such as from the group consisting of SEQ ID NO:1252, 1285, 1298, 1308, 1324, 1328, 1330, 1331, 1340, 1361, 1393, 1415, 1420 and 1421.

In one particular embodiment sequence i) corresponds to the sequence from position 8 to position 36 in a sequence selected from the group consisting of SEQ ID NO:1252, 1285, 1307, 1308, 1328, 1331, 1415, 1421, 1435, 1594 and 1679. In one embodiment sequence i) corresponds to the sequence from position 8 to position 36 in a sequence selected from the group consisting of SEQ ID NO:1252, 1328, 1435 and 1679, such as the group consisting of SEQ ID NO:1252, 1328 and 1679; the group consisting of SEQ ID NO:1252, 1435, 1679; the group consisting of SEQ ID NO:1252 and 1679; or the group consisting of SEQ ID NO:1328 and 1435. In one embodiment, sequence i) corresponds to the sequence from position 8 to position 36 in sequence selected from the group consisting of SEQ ID NO:1252, 1328 and 1435.

FIG. 1 thus exemplifies polypeptide variants whose IL-1R-I binding capacity has been verified experimentally (at least by virtue of being isolated in an affinity based assay), which variants have led to the identification of a number of individual IL-1R-I binding motif (BM) sequences which constitute individual embodiments of BM which exhibit 93%, where applicable, or 96% identity with sequence i).

In some embodiments of the present disclosure, the BM as defined above "forms part of" a three-helix bundle protein domain. This is understood to mean that the sequence of the BM is "inserted" into or "grafted" onto the sequence of the original three-helix bundle domain, such that the BM replaces a similar structural motif in the original domain. For example, without wishing to be bound by theory, the BM is thought to constitute two of the three helices of a three-helix bundle, and can therefore replace such a two-helix motif within any three-helix bundle. As the skilled person will realize, the replacement of two helices of the three-helix bundle domain by the two BM helices has to be performed so as not to affect the basic structure of the polypeptide. That is, the overall folding of the Ca backbone of the polypeptide according to this embodiment of the invention is substantially the same as that of the three-helix bundle protein domain of which it forms a part, e.g. having the same elements of secondary structure in the same order etc. Thus, a BM according to the present disclosure "forms part" of a three-helix bundle domain if the polypeptide according to this embodiment has the same fold as the original domain, implying that the basic structural properties are shared, those properties e.g. resulting in similar CD spectra. The skilled person is aware of other parameters that are relevant.

In particular embodiments, the IL-1R-I binding motif (BM) thus forms part of a three-helix bundle protein domain. For example, the BM may essentially constitute two alpha helices with an interconnecting loop, within said three-helix bundle protein domain. In particular embodiments, said three-helix bundle protein domain is selected from domains of bacterial receptor proteins. Non-limiting examples of such domains are the five different three-helical domains of Protein A from *Staphylococcus aureus*, such as domain B, and derivatives thereof. In some embodiments, the three-helical bundle protein domain is a variant of protein Z, which is derived from domain B of staphylococcal Protein A.

In some embodiments where the IL-1R-I binding polypeptide as disclosed herein forms part of a three-helix bundle protein domain, the IL-1R-I binding polypeptide may comprise a binding module (BMod), the amino acid sequence of which is selected from:

iii)

(SEQ ID NO: 1687)

K-[*BM*]-DPSQS$X_a X_b$LL$X_c$EAKKL$X_d X_e X_f$Q;

wherein

[BM] is an IL-1R-I binding motif as defined herein;

$X_a$ is selected from A and S;

$X_b$ is selected from N and E;

$X_c$ is selected from A, S and C;

$X_d$ is selected from E, N and S;

$X_e$ is selected from D, E and S;

$X_f$ is selected from A and S; and iv) an amino acid sequence which has at least 91% identity to a sequence defined by iii).

In some embodiments, said polypeptides may beneficially exhibit high structural stability, such as resistance to chemical modifications, to changes in physical conditions and to proteolysis, during production and storage, as well as in vivo.

As discussed above, polypeptides comprising minor changes as compared to the above amino acid sequences, which do not largely affect the tertiary structure and the function of the polypeptides, are also within the scope of the present disclosure. Thus, in some embodiments, sequence iv) has at least at least 93%, such as at least 95%, such as at least 97% identity to a sequence defined by iii). In particular embodiments, such minor changes as exemplified above may be present only in the flanking sequence, i.e. the parts of the sequence flanking the BM in iii) above. In other embodiments, minor changes can be present in the BM and/or in the flanking sequences.

In one embodiment, $X_a$ in sequence iii) is A.

In one embodiment, $X_a$ in sequence iii) is S.

In one embodiment, $X_b$ in sequence iii) is N.

In one embodiment, $X_b$ in sequence iii) is E.

In one embodiment, $X_c$ in sequence iii) is A.

In one embodiment, $X_c$ in sequence iii) is S.

In one embodiment, $X_c$ in sequence iii) is C.

In one embodiment, $X_d$ in sequence iii) is E.

In one embodiment, $X_d$ in sequence iii) is N.

In one embodiment, $X_d$ in sequence iii) is S.

In one embodiment, $X_e$ in sequence iii) is D.

In one embodiment, $X_e$ in sequence iii) is E.

In one embodiment, $X_e$ in sequence iii) is S.

In one embodiment, $X_d X_e$ in sequence iii) is selected from EE, ES, SE and SS.

In one embodiment, $X_d X_e$ in sequence iii) is ES.

In one embodiment, $X_d X_e$ in sequence iii) is SE.

In one embodiment, $X_f$ in sequence iii) is A.

In one embodiment, $X_f$ in sequence iii) is S.

In one embodiment, in sequence iii), $X_a$ is A; $X_b$ is N; $X_c$ is A and $X_f$ is A.

In one embodiment, in sequence iii), $X_a$ is A; $X_b$ is N; $X_c$ is C and $X_f$ is A.

In one embodiment, in sequence iii), $X_a$ is S; $X_b$ is E; $X_c$ is S and $X_f$ is S.

In one embodiment, in sequence iii), $X_a$ is S; $X_b$ is E; $X_c$ is C and $X_f$ is S.

In one embodiment, in sequence iii), $X_a$ is A; $X_b$ is N; $X_c$ is A; $X_d X_e$ is ND and $X_f$ is A.

In one embodiment, in sequence iii), $X_a$ is A; $X_b$ is N; $X_c$ is C; $X_d X_e$ is ND and $X_f$ is A.

In one embodiment, in sequence iii), $X_a$ is S; $X_b$ is E; $X_c$ is S; $X_dX_e$ is ND and $X_f$ is S.

In one embodiment, in sequence iii), $X_a$ is S; $X_b$ is E; $X_c$ is C; $X_dX_e$ is ND and $X_f$ is S.

In one embodiment, in sequence iii), $X_a$ is A; $X_b$ is N; $X_c$ is A; $X_dX_e$ is SE and $X_f$ is A.

In one embodiment, in sequence iii), $X_a$ is A; $X_b$ is N; $X_c$ is C; $X_dX_e$ is SE and $X_f$ is A.

In one embodiment, in sequence iii), $X_a$ is S; $X_b$ is E; $X_c$ is S; $X_dX_e$ is SE and $X_f$ is S.

In one embodiment, in sequence iii), $X_a$ is S; $X_b$ is E; $X_c$ is C; $X_dX_e$ is SE and $X_f$ is S.

In one embodiment, in sequence iii), $X_a$ is A; $X_b$ is N; $X_c$ is A; $X_dX_e$ is ES and $X_f$ is A.

In one embodiment, in sequence iii), $X_a$ is A; $X_b$ is N; $X_c$ is C; $X_dX_e$ is ES and $X_f$ is A.

In one embodiment, in sequence iii), $X_a$ is S; $X_b$ is E; $X_c$ is S; $X_dX_e$ is ES and $X_f$ is S.

In one embodiment, in sequence iii), $X_a$ is S; $X_b$ is E; $X_c$ is C; $X_dX_e$ is ES and $X_f$ is S.

In one embodiment, sequence iii) or iv) corresponds to the sequence from position 7 to position 55 in a sequence selected from the group consisting of SEQ ID NO:1-1638 and 1667-1670.

In yet a further embodiment, sequence iii) corresponds to the sequence from position 7 to position 55 in a sequence selected from the group consisting of SEQ ID NO:1-1638, 1667-1668 and 1670-1679; such as the group consisting of SEQ ID NO:20-1638 and 1670-1679. In one embodiment sequence iii) corresponds to the sequence from position 7 to position 55 in a sequence selected from the group consisting of SEQ ID NO:1206-1638 and 1670-1679, such as the group consisting of SEQ ID NO:1206-1632 and 1670-1679, such as the group consisting of SEQ ID NO:1210-1638 and 1670-1679, such as the group consisting of SEQ ID NO:1210-1632 and 1670-1679.

In one embodiment sequence iii) corresponds to the sequence from position 7 to position 55 in a sequence selected from the group consisting of SEQ ID NO:1205, 1250-1632 and 1670-1679.

In one embodiment sequence iii) corresponds to the sequence from position 7 to position 55 in a sequence selected from the group consisting of SEQ ID NO:1206-1252, 1672 and 1679.

In another embodiment sequence iii) corresponds to the sequence from position 7 to position 55 in a sequence selected from the group consisting of SEQ ID NO:1253-1632, 1670-1671 and 1673-1678. In another embodiment sequence iii) corresponds to the sequence from position 7 to position 55 in a sequence selected from the group consisting of SEQ ID NO:1253-1441, 1670-1671 and 1674-1678 or the group consisting of SEQ ID NO:1442-1632 and 1673.

In one embodiment, sequence iii) corresponds to the sequence from position 7 to position 55 in a sequence selected from the group consisting of SEQ ID NO:158, 227, 268, 294, 325, 1176, 1205, 1251, 1252, 1270, 1284, 1285, 1298, 1307, 1308, 1311, 1324, 1328, 1330, 1331, 1334, 1339, 1340, 1343, 1353, 1361, 1362, 1364, 1367, 1368, 1375, 1393, 1415, 1420, 1421, 1422, 1423, 1435, 1471, 1472, 1571, 1594, 1662 and 1670-1679, such as from the group consisting of SEQ ID NO:268, 1205, 1252, 1270, 1284, 1285, 1298, 1307, 1308, 1324, 1328, 1330, 1331, 1334, 1339, 1340, 1343, 1361, 1364, 1367, 1368, 1375, 1393, 1415, 1420, 1421, 1422, 1423, 1571, 1670-1672, 1674, and 1676-1679, such as from the group consisting of SEQ ID NO:1252, 1285, 1298, 1308, 1324, 1328, 1330, 1331, 1340, 1361, 1393, 1415, 1420, 1421, 1670-1672, 1674, 1676-1677 and 1679.

In one particular embodiment sequence iii) corresponds to the sequence from position 7 to position 55 in a sequence selected from the group consisting of SEQ ID NO:1252, 1285, 1307, 1308, 1328, 1331, 1415, 1421, 1435, 1594 and 1670-1679. In one embodiment sequence iii) corresponds to the sequence from position 7 to position 55 in a sequence selected from the group consisting of SEQ ID NO:1252, 1328, 1435, 1672, 1675-1676 and 1679 such as the group consisting of SEQ ID NO:1252, 1328 and 1679; the group consisting of SEQ ID NO:1252, 1435 and 1679; or the group consisting of SEQ ID NO:1328 and 1435. In one embodiment, sequence i) corresponds to the sequence from position 7 to position 55 in sequence selected from the group consisting of SEQ ID NO:1252, 1328 and 1435.

In one embodiment, sequence iii) corresponds to the sequence from position 7 to position 55 in a sequence selected from the group consisting of SEQ ID NO:1672, 1675-1676 and 1679, such as the group consisting of SEQ ID NO:1672 and 1675-1676.

Also, in a further embodiment, there is provided an IL-1R-I binding polypeptide, which comprises an amino acid sequence selected from:

v) (SEQ ID NO: 1688)
YA-[BMod]-AP;

wherein [BMod] is an IL-1R-I binding module as defined herein; and vi) an amino acid sequence which has at least 90% identity to a sequence defined in v).

Alternatively, there is provided an IL-1R-I binding polypeptide, which comprises an amino acid sequence selected from:

vii) (SEQ ID NO: 1689)
FN-[BMod]-AP;

wherein [BMod] is an IL-1R-I binding module as defined herein; and viii) an amino acid sequence which has at least 90% identity to a sequence defined in vii).

In one embodiment there is provided an IL-1R-I binding polypeptide, which comprises an amino acid selected from the group consisting of ix) (SEQ ID NO: 1690)
FNK-[BM]-DPSQS ANLLX$_c$ EAKKL NDAQA P;

wherein [BM] is an IL-1R-I binding motif as defined above and $X_c$ is selected from A and C; and x) an amino acid sequence which has at least 90% identity to a sequence defined in ix).

In another embodiment, there is provided an IL-1R-I binding polypeptide, which comprises an amino acid selected from the group consisting of xi) (SEQ ID NO: 1691)
FAK-[BM]-DPSQS SELLX$_c$ EAKKL SESQA P;

wherein [BM] is an IL-1R-I binding motif as defined above and $X_c$ is selected from A, S and C; and xii) an amino acid sequence which has at least 90% identity to a sequence defined in xi).

In another embodiment, there is provided an IL-1R-I binding polypeptide, which comprises an amino acid selected from the group consisting of xiii)
(SEQ ID NO: 1692)
FAK-[BM]-DPSQS SELLX$_c$ EAKKL NDSQA P;

wherein [BM] is an IL-1R-I binding motif as defined above and $X_c$ is selected from A, S and C;

xiv) an amino acid sequence which has at least 90% identity to a sequence defined in xiii).

In yet another embodiment, there is provided an IL-1R-I binding polypeptide, which comprises an amino acid selected from the group consisting of xv)
(SEQ ID NO: 1693)
YAK-[BM]-DPSQS SELLX$_c$ EAKKL X$_d$X$_e$SQA P;

wherein [BM] is an IL-1R-I binding motif as defined above and $X_c$ is selected from A, S and C, $X_d$ is selected from E, N and S, and $X_e$ is selected from D, E and S;

xvi) and an amino acid sequence which has at least 90% identity to a sequence defined in xv).

In yet another embodiment, there is provided an IL-1R-I binding polypeptide, which comprises an amino acid selected from the group consisting of xvii)
(SEQ ID NO: 1694)
KYAK-[BM]-DPSQS SELLX$_c$ EAKKL X$_d$X$_e$SQA P;

wherein [BM] is an IL-1R-I binding motif as defined above and $X_c$ is selected from A, S and C, $X_d$ is selected from E, N and S, and $X_e$ is selected from D, E and S;

xviii) and an amino acid sequence which has at least 90% identity to a sequence defined in xvii).

As discussed above, polypeptides comprising minor changes as compared to the above amino acid sequences, which do not largely affect the tertiary structure and the function of the polypeptide, also fall within the scope of the present disclosure. Thus, in some embodiments, sequence vi), viii), x), xii), xiv), xvi) or xviii) may for example be at least 90%, such as at least 92%, such as at least 94%, such as at least 96%, such as at least 98% identical to a sequence defined by v), vii), ix), xi), xiii), xv) and xvii), respectively. In particular embodiments, such minor changes as exemplified above can be present only in flanking sequences, i.e. the parts of the sequences flanking the BM in v), vii), ix), xi), xiii), xv) and xviii). In other embodiments, minor changes can be present in the BM and/or in the flanking sequences.

In some embodiments, the IL-1R-I binding motif may form part of a polypeptide comprising an amino acid sequence selected from:

SEQ ID NO: 1695
ADNNFNK-[*BM*]DPSQSANLLSEAKKLNESQAPK;

SEQ ID NO: 1696
ADNKFNK-[*BM*]DPSQSANLLAEAKKLNDAQAPK;

-continued

SEQ ID NO: 1697
ADNKFNK-[*BM*]DPSVSKEILAEAKKLNDAQAPK;

SEQ ID NO: 1698
ADAQQNNFNK-[*BM*]DPSQSTNVLGEAKKLNESQAPK;

SEQ ID NO: 1699
AQHDE-[*BM*]DPSQSANVLGEAQKLNDSQAPK;

SEQ ID NO: 1700
VDNKFNK-[*BM*]DPSQSANLLAEAKKLNDAQAPK;

SEQ ID NO: 1701
AEAKYAK-[*BM*]DPSESSELLSEAKKLNKSQAPK;

SEQ ID NO: 1702
VDAKYAK-[*BM*]DPSQSSELLAEAKKLNDAQAPK;

SEQ ID NO: 1703
VDAKYAK-[*BM*]DPSQSSELLAEAKKLNDSQAPK;

SEQ ID NO: 1704
AEAKYAK-[*BM*]DPSQSSELLSEAKKLNDSQAPK;

SEQ ID NO: 1705
AEAKYAK-[*BM*]DPSQSSELLSEAKKLNDSQAP;

SEQ ID NO: 1706
AEAKFAK-[*BM*]DPSQSSELLSEAKKLNDSQAPK;

SEQ ID NO: 1707
AEAKFAK-[*BM*]DPSQSSELLSEAKKLNDSQAP;

SEQ ID NO: 1708
AEAKYAK-[*BM*]DPSQSSELLAEAKKLNDAQAPK;

SEQ ID NO: 1709
AEAKYAK-[*BM*]DPSQSSELLSEAKKLSESQAPK;

SEQ ID NO: 1710
AEAKYAK-[*BM*]DPSQSSELLSEAKKLSESQAP;

SEQ ID NO: 1711
AEAKFAK-[*BM*]DPSQSSELLSEAKKLSESQAPK;

SEQ ID NO: 1712
AEAKFAK-[*BM*]DPSQSSELLSEAKKLSESQAP;

SEQ ID NO: 1713
AEAKYAK-[*BM*]DPSQSSELLAEAKKLSEAQAPK;

SEQ ID NO: 1714
AEAKYAK-[*BM*]DPSQSSELLSEAKKLESSQAPK;

SEQ ID NO: 1715
AEAKYAK-[*BM*]DPSQSSELLSEAKKLESSQAP;

SEQ ID NO: 1716
AEAKYAK-[*BM*]DPSQSSELLAEAKKLESAQAPK;

SEQ ID NO: 1717
AEAKYAK-[*BM*]DPSQSSELLSEAKKLSDSQAPK;

SEQ ID NO: 1718
AEAKYAK-[*BM*]DPSQSSELLSEAKKLSDSQAP;

SEQ ID NO: 1719
AEAKYAK-[*BM*]DPSQSSELLAEAKKLSDSQAPK;

SEQ ID NO: 1720
AEAKYAK-[*BM*]DPSQSSELLAEAKKLSDAQAPK;

SEQ ID NO: 1721
VDAKYAK-[*BM*]DPSQSSELLSEAKKLNDSQAPK;

SEQ ID NO: 1722
VDAKYAK-[*BM*]DPSQSSELLAEAKKLNDAQAPK;

SEQ ID NO: 1723
VDAKYAK-[*BM*]DPSQSSELLSEAKKLSESQAPK;

-continued

VDAKYAK-[BM]DPSQSSELLAEAKKLSEAQAPK; (SEQ ID NO: 1724)

VDAKYAK-[BM]DPSQSSELLSEAKKLESSQAPK; (SEQ ID NO: 1725)

VDAKYAK-[BM]DPSQSSELLAEAKKLESAQAPK; (SEQ ID NO: 1726)

VDAKYAK-[BM]DPSQSSELLSEAKKLSDSQAPK; (SEQ ID NO: 1727)

VDAKYAK-[BM]DPSQSSELLAEAKKLSDSQAPK; (SEQ ID NO: 1728)

VDAKYAK-[BM]DPSQSSELLAEAKKLSDAQAPK; (SEQ ID NO: 1729)

VDAKYAK-[BM]DPSQSSELLAEAKKLNKAQAPK; (SEQ ID NO: 1730)

AEAKYAK-[BM]DPSQSSELLAEAKKLNKAQAPK, and (SEQ ID NO: 1731)

ADAKYAK-[BM]DPSQSSELLSEAKKLNDSQAPK, (SEQ ID NO: 1732)

wherein [BM] is an IL-1R-I binding motif as defined herein.

In one embodiment, said IL-1R-I binding polypeptide comprises an amino acid sequence which has at least 89% identity to any one of the sequences defined above.

In one embodiment, the IL-1R-I binding polypeptide comprises an amino acid sequence selected from:

xix)
VDAKYAK-[BM]-DPSQSSELLSEAKKLNDSQAPK (SEQ ID NO: 1721)

wherein [BM] is an IL-1R-I binding motif as defined herein; and xx) an amino acid sequence which has at least 89% identity to the sequence defined in xix).

In one embodiment, the IL-1R-I binding polypeptide comprises an amino acid sequence selected from:

xxi)
AEAKYAK-[BM]-DPSQSSELLSEAKKLSESQAPK (SEQ ID NO: 1709)

wherein [BM] is an IL-1R-I binding motif as defined herein; and xxii) an amino acid sequence which has at least 89% identity to the sequence defined in xxi).

In one particular embodiment, said IL-1R-I binding polypeptide comprises an amino acid sequence selected from the group consisting of SEQ ID NO:1667-1668 and 1670-1679.

In one embodiment, the IL-1R-I binding polypeptide comprises an amino acid sequence selected from:
xxiii) AEAKFAK-[BM]-DPSQSSELLSEAKKLS-ESQAPK (SEQ ID NO:1711) wherein [BM] is an IL-1R-I binding motif as defined herein; and xxiv) an amino acid sequence which has at least 89% identity to the sequence defined in xxiii).

Again, polypeptides comprising minor changes as compared to the above amino acid sequences, which do not largely affect the tertiary structure and the function of the polypeptide, also fall within the scope of the present disclosure. Thus, in some embodiments, sequence xx), xxii) or xxiv) may for example be at least 89%, such as at least 91%, such as at least 93%, such as at least 94%, such as at least 96%, such as at least 98% identical to a sequence defined by xix), xxi) or xxiii) respectively. Once again, in particular embodiments such minor changes as exemplified above can be present only in the sequences flanking the BM as set out in xix), xxi) or xxiii). In other embodiments, minor changes can be present in the BM and/or in the flanking sequences.

Sequence xix)-xxiv) in such IL-1R-I binding polypeptide may be selected from the sequence from position 1 to position 58 in a sequence selected from the group consisting of SEQ ID NO:1-1638, 1667-1668 and 1670-1679 as presented in FIG. 1.

In one embodiment of the IL-1R-I binding polypeptide according to this aspect, sequence xix), xxi) or xxiii) corresponds to the sequence from position 1 to position 58 in a sequence selected from the group consisting of SEQ ID NO:1-1632, 1667-1668 and 1670-1679; such as the group consisting of SEQ ID NO:20-1638, 1667-1668 and 1670-1679. In one embodiment sequence xix), xxi) or xxiii) corresponds to the sequence from position 1 to position 58 in a sequence selected from the group consisting of SEQ ID NO:1206-1632, 1667-1668 and 1670-1679, such as the group consisting of SEQ ID NO:1210-1632, 1667-1668 and 1670-1679.

In one embodiment sequence xvii), xix) or xxi) corresponds to the sequence from position 1 to position 58 in a sequence selected from the group consisting of SEQ ID NO:1205, 1250-1632 and 1670-1679.

In one embodiment sequence xix), xxi) or xxiii) corresponds to the sequence from position 1 to position 58 in a sequence selected from the group consisting of SEQ ID NO:1206-1252, 1672 and 1679.

In another embodiment sequence xix), xxi) or xxiii) corresponds to the sequence from position 1 to position 58 in a sequence selected from the group consisting of SEQ ID NO:1253-1632, 1670-1671 and 1673-1678. In another embodiment sequence xix), xxi) or xxiii) corresponds to the sequence from position 1 to position 58 in a sequence selected from the group consisting of SEQ ID NO:1253-1441, 1670-1671 and 1674-1678 or the group consisting of 1442-1632 and 1673.

In one embodiment sequence xix), xxi) or xxiii) corresponds to the sequence from position 1 to position 58 in a sequence selected from the group consisting of SEQ ID NO:158, 227, 268, 294, 325, 1176, 1205, 1251, 1252, 1270, 1284, 1285, 1298, 1307, 1308, 1311, 1324, 1328, 1330, 1331, 1334, 1339, 1340, 1343, 1353, 1361, 1362, 1364, 1367, 1368, 1375, 1393, 1415, 1420, 1421, 1422, 1423, 1435, 1471, 1472, 1571, 1594, 1662 and 1670-1679, such as from the group consisting of SEQ ID NO:268, 1205, 1252, 1270, 1284, 1285, 1298, 1307, 1308, 1324, 1328, 1330, 1331, 1334, 1339, 1340, 1343, 1361, 1364, 1367, 1368, 1375, 1393, 1415, 1420, 1421, 1422, 1423, 1571, 1670-1672, 1674 and 1676-1679, such as from the group consisting of SEQ ID NO:1252, 1285, 1298, 1308, 1324, 1328, 1330, 1331, 1340, 1361, 1393, 1415, 1420, 1421, 1670-1672, 1674, 1676-1677 and 1679.

In one particular embodiment sequence xix), xxi) or xxiii) corresponds to the sequence from position 1 to position 58 in a sequence selected from the group consisting of SEQ ID NO:1252, 1285, 1307, 1308, 1328, 1331, 1415, 1421, 1435, 1594 and 1670-1679. In one embodiment sequence xix), xxi) or xxiii) corresponds to the sequence from position 1 to position 58 in a sequence selected from the group consisting of SEQ ID NO:1252, 1328, 1435 1672, 1675-1676 and 1679, such as the group consisting of SEQ ID NO:1252, 1328 and 1679; the group consisting of SEQ ID NO:1252, 1435 and 1679; or the group consisting of SEQ ID NO:1328 and 1435. In one embodiment, sequence xix), xxi) or xxiii) corresponds to the sequence from position 1 to position 58 in a sequence selected from the group consisting of SEQ ID NO:1252, 1328 and 1435.

In one embodiment, sequence xix), xxi) or xxiii) corresponds to the sequence from position 1 to position 58 in a sequence selected from the group consisting of SEQ ID NO:1672, 1675-1676 and 1679, such as from the group consisting of SEQ ID NO:1672, 1675 and 1676.

In one embodiment, said IL-1R-I binding polypeptide has a melting temperature of above 45° C.

Binding of a polypeptide as defined herein to IL-1R-I may interfere with signaling via IL-1R-I either in vivo or in vitro. Thus, in one embodiment, there is provided an IL-1R-I binding polypeptide as defined herein which is capable of blocking IL-1R-I dependent signaling.

The half maximal inhibitory concentration ($IC_{50}$) is a measure of the effectiveness of a substance for inhibiting a specific quantifiable biological or biochemical function. This quantitative measure indicates how much of a particular substance is needed to inhibit a specific biological function by 50% and is commonly used in the art. In one particular embodiment, there is provided an IL-1R-I binding polypeptide as defined herein capable of blocking IL-1R-I signaling such that the half maximal inhibitory concentration ($IC_{50}$) of the blocking is at most $1\times10^{-7}$ M, such as at most $5\times10^{-8}$ M, such as at most $2\times10^{-8}$ M, such as at most $1\times10^{-8}$ M, such as at most $5\times10^{-9}$ M, such as at most $2\times10^{-9}$ M, such as at most $1\times10^{-9}$ M, such as at most $5\times10^{-10}$ M, such as at most $4\times10^{-10}$ M, such as at most $3\times10^{-10}$ M. In one embodiment, the half maximal inhibitory concentration ($IC_{50}$) of the blocking is between $1\times10^{-15}$ M and $1\times10^{-7}$ M, such as between $1\times10^{-15}$ M and $1\times10^{-8}$ M, such as between $1\times10^{-15}$ M and $1\times10^{-9}$ M, such as between $1\times10^{-15}$ M and $1\times10^{-10}$ M, such as between $1\times10^{-15}$ M and $1\times10^{-11}$ M, such as between $1\times10^{-15}$ M and $1\times10^{-12}$ M.

The terms "IL-1R-I binding" and "binding affinity for IL-1R-I" as used in this specification refer to a property of a polypeptide which may be tested for example by ELISA, Biolayer Interferometry (BLI) or the use of surface plasmon resonance (SPR) technology. For example as described in the examples below, IL-1R-I binding affinity may be tested in an experiment in which samples of the polypeptide are captured on antibody-coated ELISA plates and biotinylated IL-1R-I is added followed by streptavidin-conjugated HRP. TMB substrate is added and the absorbance at 450 nm is measured using a multi-well plate reader, such as Victor$^3$ (Perkin Elmer). The skilled person may then interpret the results obtained by such experiments to establish at least a qualitative measure of the binding affinity of the polypeptide for IL-1R-I. If a quantitative measure is desired, for example to determine the $EC_{50}$ value (the half maximal effective concentration) for the interaction, ELISA may also be used. The response of the polypeptide against a dilution series of biotinylated IL-1R-I is measured using ELISA as described above. The skilled person may then interpret the results obtained by such experiments, and $EC_{50}$ values may be calculated from the results using for example GraphPad Prism 5 and non-linear regression.

IL-1R-I binding affinity may also be tested in an experiment in which IL-1R-I, or a fragment thereof, is immobilized on a sensor chip of a surface plasmon resonance (SPR) instrument, and the sample containing the polypeptide to be tested is passed over the chip. Alternatively, the polypeptide to be tested is immobilized on a sensor chip of the instrument, and a sample containing IL-1R-I, or a fragment thereof, is passed over the chip. The skilled person may then interpret the results obtained by such experiments to establish at least a qualitative measure of the binding affinity of the polypeptide for IL-1R-I. If a quantitative measure is desired, for example to determine a $K_D$ value for the interaction, surface plasmon resonance methods may also be used. Binding values may for example be defined in a Biacore (GE Healthcare) or ProteOn XPR 36 (Bio-Rad) instrument. IL-1R-I is suitably immobilized on a sensor chip of the instrument, and samples of the polypeptide whose affinity is to be determined are prepared by serial dilution and injected in random order. $K_D$ values may then be calculated from the results using for example the 1:1 Langmuir binding model of the BIAevaluation 4.1 software, or other suitable software, provided by the instrument manufacturer.

Thus, in one embodiment, there is provided an IL-1R-I binding polypeptide as defined herein, which is capable of binding to IL-1R-I such that the $EC_{50}$ value of the interaction is at most $1\times10^{-7}$ M, such as at most $5\times10^{-8}$ M, such as at most $1\times10^{-8}$ M, such as at most $5\times10^{-9}$ M, such as at most $1\times10^{-9}$ M, such as at most $5\times10^{-10}$ M, such as at most $4\times10^{-10}$ M, such as at most $3\times10^{-10}$ M, such as at most $2\times10^{-10}$ M. In one embodiment, the $EC_{50}$ value of the interaction is between $1\times10^{-15}$ M and $1\times10^{-7}$ M, such as between $1\times10^{-15}$ M and $1\times10^{-8}$ M, such as between $1\times10^{-15}$ M and $1\times10^{-9}$ M, such as between $1\times10^{-15}$ M and $5\times10^{-10}$ M, such as between $1\times10^{-15}$ M and $1\times10^{-10}$ M, such as between $1\times10^{-15}$ M and $5\times10^{-11}$ M, such as between $1\times10^{-15}$ M and $1\times10^{-11}$ M, such as between $1\times10^{-15}$ M and $5\times10^{-12}$ M, such as between $1\times10^{-15}$ M and $1\times10^{-12}$ M.

In one particular embodiment, there is provided an IL-1R-I binding polypeptide which is capable of binding to IL-1R-I such that the $K_D$ value of the interaction with IL-1R-I is at most $1\times10^{-6}$ M, such as at most $1\times10^{-7}$ M, such as at most $5\times10^{-8}$ M, such as at most $4\times10^{-8}$ M, such as at most $3\times10^{-8}$ M, such as at most $2\times10^{-8}$ M, such as at most $1\times10^{-8}$ M, such as at most $7\times10^{-9}$ M, such as at most $5\times10^{-9}$ M, such as at most $4\times10^{-9}$ M, such as at most $3\times10^{-9}$ M, such as at most $2\times10^{-9}$ M, such as at most $1\times10^{-9}$ M, such as at most $9\times10^{-10}$ M, such as at most $7\times10^{-10}$ M, such as at most $5\times10^{-10}$ M. In one embodiment, the $K_D$ value of the interaction with IL-1R-I is between $1\times10^{-15}$ M and $1\times10^{-6}$ M, between $1\times10^{-15}$ M and $1\times10^{-7}$ M, such as between $1\times10^{-15}$ M and $1\times10^{-8}$ M, such as between $1\times10^{-15}$ M and $1\times10^{-9}$ M, such as between $1\times10^{-15}$ M and $1\times10^{-10}$ M, such as between $1\times10^{-15}$ M and $1\times10^{-11}$ M, such as between $1\times10^{-15}$ M and $1\times10^{-12}$ M.

In one embodiment, there is provided an IL-1R-I binding polypeptide as defined herein, wherein said IL-1R-I is human IL-1R-I or cynomolgus IL-1R-I, such as human IL-1R-I.

The IL-1R-I binding polypeptide as defined herein may be capable of blocking the interaction of IL-1R-I with IL-1 cytokines, such as the interaction of IL-1R-I with IL-1α and/or IL-1β. Thus, in one embodiment said IL-1R-I binding polypeptide is capable of blocking the interaction of IL-1R-I with IL-1 cytokines, such as the interaction of IL-1R-I with IL-1α and/or IL-1β.

The skilled person will understand that various modifications and/or additions can be made to an IL-1R-I binding polypeptide according to any aspect disclosed herein in order to tailor the polypeptide to a specific application without departing from the scope of the present disclosure.

For example, in one embodiment there is provided an IL-1R-I binding polypeptide as described herein, which polypeptide has been extended by and/or comprises additional amino acids at the C terminus and/or N terminus. Such a polypeptide should be understood as a polypeptide having one or more additional amino acid residues at the very first and/or the very last position in the polypeptide chain. Thus, an IL-1R-I binding polypeptide may comprise any suitable number of additional amino acid residues, for example at least one additional amino acid residue. Each additional amino acid residue may individually or collectively be added in order to, for example, improve production, purification, stabilization in vivo or in vitro, coupling or detection of the polypeptide. Such additional amino acid residues may comprise one or more amino acid residues added for the purpose of chemical coupling. One example of this is the addition of a cysteine residue. Additional amino acid residues may also provide a "tag" for purification or detection of the polypeptide, such as a $His_6$ tag, a $(HisGlu)_3$ tag ("HEHEHE" tag), a "myc" (c-myc) tag or a "FLAG" tag for interaction with antibodies specific to the tag or for immobilized metal affinity chromatography (IMAC) in the case of a $His_6$-tag.

The further amino acids as discussed above may be coupled to the IL-1R-I binding polypeptide by means of chemical conjugation (using known organic chemistry methods) or by any other means, such as expression of the IL-1R-I binding polypeptide as a fusion protein or joined in any other fashion, either directly or via a linker, for example an amino acid linker.

The further amino acids as discussed above may for example comprise one or more polypeptide domain(s). A further polypeptide domain may provide the IL-1R-I binding polypeptide with another function, such as for example yet another binding function, an enzymatic function, a toxic function, a fluorescent signaling function or combinations thereof.

A further polypeptide domain may moreover provide another IL-1R-I binding moiety with the same IL-1R-I binding function. Thus, in a further embodiment, there is provided an IL-1R-I binding polypeptide in a multimeric form. Said multimer is understood to comprise at least two IL-1R-I binding polypeptides as disclosed herein as monomer units, the amino acid sequences of which may be the same or different. Multimeric forms of the polypeptides may comprise a suitable number of domains, each having an IL-1R-I binding motif, and each forming a monomer within the multimer. These domains may have the same amino acid sequence, but alternatively, they may have different amino acid sequences. In other words, the IL-1R-I binding polypeptide of the invention may form homo- or heteromultimers, for example homo- or heterodimers. In one embodiment, there is provided an IL-1R-I binding polypeptide, wherein said monomeric units are covalently coupled together. In one embodiment, there is provided an IL-1R-I binding polypeptide, wherein said monomeric units are non-covalently coupled together. In another embodiment, said IL-1R-I binding polypeptide monomer units are expressed as a fusion protein. In one embodiment, there is provided an IL-1R-I binding polypeptide in dimeric form. One example of an IL-1R-I binding polypeptide which will form a disulphide bonded dimer after production is the polypeptide having the sequence set out in SEQ ID NO:1658. The hinge region of IgG1 Fc (disclosed in FIG. 1 as position 1-16 of SEQ ID NO:1662) may be used to accomplish dimeric forms of IL-1R-I binding polypeptides.

Additionally, "heterogenic" fusion polypeptides or proteins, or conjugates, in which an IL-1R-I binding polypeptide as described herein, or a multimer thereof, constitutes a first domain, or first moiety, and the second and further moieties have other functions than binding to IL-1R-1, are also contemplated and fall within the ambit of the present disclosure. The second and further moiety/moieties of the fusion polypeptide or conjugate in such a protein suitably also have a desired biological activity.

Thus, in a second aspect of the present disclosure, there is provided a fusion protein or a conjugate, comprising a first moiety consisting of an IL-1R-1 binding polypeptide according to the first aspect, and a second moiety consisting of a polypeptide having a desired biological activity. In another embodiment, said fusion protein or conjugate may additionally comprise further moieties, comprising desired biological activities that can be either the same or different from the biological activity of the second moiety.

Thus, in one embodiment, said IL-1R-I binding polypeptide comprises an IL-1R-I binding motif BM as set out in sequence i) or ii); a binding module BMod as set out in sequence iii) or iv), or an amino acid sequence as set out in any one of sequences v)-xxiv). In particular, said IL-1R-I binding motifs may correspond to an amino acid sequence from position 8 to 36; said binding modules may correspond to an amino acid sequence from position 7 to position 55; and said sequence xix), xxi), or xxiii) may be selected from the group consisting of sequences selected from SEQ ID NO:s shown in FIG. 1 and listed above. Preferred embodiments of IL-1R-I binding polypeptides are disclosed in the first aspect.

Non-limiting examples of a desired biological activity comprise a therapeutic activity, a binding activity, and an in vivo half-life increasing activity.

In one embodiment, said desired biological activity is an in vivo half-life increasing activity such that said second moiety increases in vivo half-life of the fusion protein or conjugate.

An in vivo half-life increasing activity should in this context be understood as an activity which increases the in vivo half-life of the fusion protein or conjugate. The half-life of a first moiety (and possibly additional moieties) is increased by fusion or conjugation to a second moiety having an in vivo half-life increasing activity. It will be appreciated that the corresponding fusion protein or conjugate may comprise a first IL-1R-I binding moiety as described above, a second moiety having an in vivo half-life increasing activity, and optionally one or more additional moieties, such as an additional IL-1R-I binding moiety. For example, said fusion protein or conjugate may comprise two IL-1R-I binding polypeptides and a second moiety which increases in vivo half-life compared to the fusion or conjugate comprising the two IL-1R-I binding polypeptides only. Examples of fusion proteins comprising an IL-1R-I binding polypeptide and a half-life extending moiety have been produced and experimentally tested (Example 10). In one embodiment, said fusion protein or conjugate comprises a polypeptide having an amino acid sequence selected from the group consisting of SEQ ID NO:1639-1657.

Half-life extension of the resulting fusion protein or conjugate may be accomplished by a second moiety having an inherently long in vivo half-life. A polypeptide that increases the hydrodynamic size of the fusion protein or conjugate may for example impose an increased half-life upon the fusion protein or conjugate. Alternatively, the second moiety may consist of a natural protein having a long in vivo half-life, such as serum albumin or the Fc portion of an antibody.

In one embodiment, said second moiety comprises one of the albumin binding domain of streptococcal protein G or a derivative thereof; albumin; an Fc portion of an antibody, and transferrin. In one embodiment, said fusion protein or conjugate comprises a sequence selected from the group consisting of SEQ ID NO:1639-1658.

In one embodiment, said second moiety is an Fc portion of an antibody, such as an IgG1 Fc (SEQ ID NO:1662) or an IgG4 Fc. An IgG4 Fc that may be used as a half-life extending moiety is the Fc part set out in Uniprot, accession number P01861, amino acid residues 99-327. In one embodiment, said fusion protein or conjugate comprises a polypeptide having an amino acid sequence selected from the group consisting of SEQ ID NO:1646-1654.

In one embodiment, said Fc portion of an antibody is a mutated Fc which relative to an unmutated form of Fc displays improved affinity to FcRn and/or reduced effector response. Thus, said Fc portion is a variant of a naturally occurring Fc in which one or more mutations have been introduced. For example, said fusion protein or conjugate comprises a polypeptide having an amino acid sequence selected from the group consisting of SEQ ID NO:1734-1737.

In another non-limiting example, wherein said second moiety has in vivo half-life increasing activity, said second moiety is transferrin. In particular embodiments of the fusion protein or conjugate disclosed herein, there is provided a polypeptide selected from the group consisting of SEQ ID NO:1657.

In one particular embodiment, the in vivo half-life increasing activity is an albumin binding activity. Non-limiting examples of moieties providing such an albumin binding activity are an albumin binding camelid Ig $V_{HH}$ domain and an albumin binding engineered single Ig $V_H$ domain.

In one embodiment, said albumin binding activity is provided by the albumin binding domain of the peptostreptococcal albumin binding (PAB) protein from *Finegoldia magna*, or a derivative thereof.

In one embodiment, said albumin binding activity is provided by the albumin binding domain of streptococcal protein G, or a derivative thereof. Examples of such an albumin binding domain are polypeptides having an amino acid sequence as set out in SEQ ID NO:1659-1661. Preferably, the albumin binding domain is as set out in SEQ ID NO:1661. In one embodiment, said fusion protein or conjugate comprises a polypeptide having an amino acid sequence selected from the group consisting of SEQ ID NO:1639-1645.

In another non-limiting example, said in vivo half-life increasing activity is provided by a polyethylene glycol (PEG) or a hydroxyethyl starch (HES).

For example, said fusion protein or conjugate, comprising at least one further moiety, may comprise [IL-1R-I binding polypeptide]-[half-life increasing moiety]-[moiety with affinity for selected target]. It is to be understood that the three moieties in this example may be arranged in any order from the N- to the C-terminal of the polypeptide.

Another non-limiting example is a binding activity which allow the fusion protein to display a modified tissue distribution compared to the unfused IL-1R-I binding polypeptide. In one embodiment the binding activity is binding to the transferrin receptor. Such a binding activity could infer that the conjugate or fusion protein is transferred across the blood brain barrier and into the brain tissue (Yu et al, 2011, Sci Transl Med 3(84):84ra44). In a preferred embodiment, such binding activity is provided by an antibody fragment.

Another non-limiting example of a binding activity is an activity which acts to block a biological activity.

In one embodiment, there is provided an IL-1R-I binding polypeptide, fusion protein or conjugate wherein the binding activity acts to block a biological activity.

With regard to the description above of fusion proteins or conjugates incorporating an IL-1R-I binding polypeptide according to the disclosure, it is to be noted that the designation of first, second and further moieties is made for clarity reasons to distinguish between an IL-1R-I binding polypeptide or polypeptides according to the invention on the one hand, and moieties exhibiting other functions on the other hand. These designations are not intended to refer to the actual order of the different domains in the polypeptide chain of the fusion protein or conjugate. Similarly, the designations first and second monomer units are made for clarity reasons to distinguish between said units. Thus, for example, said first moiety (or monomer unit) may without restriction appear at the N-terminal end, in the middle, or at the C-terminal end of the fusion protein or conjugate.

The skilled person is aware that the construction of a fusion protein often involves the use of linkers between the functional moieties to be fused, and there are different kinds of linkers with different properties, such as flexible amino acid linkers, rigid amino acid linkers and cleavable amino acid linkers. Linkers have been used to for example increase stability or improve folding of fusion proteins, to increase expression, improve biological activity, enable targeting and alter pharmacokinetics of fusion proteins. Thus, in one embodiment, the polypeptide according to any aspect disclosed herein further comprises at least one linker, such as at least one linker selected from flexible amino acid linkers, rigid amino acid linkers and cleavable amino acid linkers.

In one embodiment, said linker is arranged between a first moiety consisting of an IL-1R-I binding polypeptide as defined herein and a second moiety consisting of a polypeptide having a desired biological activity. In another embodiment, said linker is arranged within said first moiety. For example, one or more linker(s) may be arranged between monomeric units of the polypeptide as defined herein. In yet another embodiment, linkers may be arranged within said first moiety and between said first moiety and said second moiety.

Flexible linkers are often used in the art when the joined domains require a certain degree of movement or interaction, and may be particularly useful in some embodiments. Such linkers are generally composed of small, non-polar (for example G) or polar (for example S or T) amino acids. Some flexible linkers primarily consist of stretches of G and S residues, for example $(GGGGS)_p$. Adjusting the copy number "p" allows for optimization of linker in order to achieve appropriate separation between the functional moieties or to maintain necessary inter-moiety interaction. Apart from G and S linkers, other flexible linkers are known in the art, such as G and S linkers containing additional amino acid residues, such as T and A, to maintain flexibility, as well as polar amino acid residues to improve solubility. In one embodiment, said linker is a flexible linker comprising at least one amino acid residue(s) selected from the group consisting of glycine, serine and alanine. The skilled person is aware of other suitable linkers.

In one embodiment, said linker is selected from GS, VDSS, VDGS, VEGS, ASGS, $(GGGGS)_2$ (SEQ ID NO:1683), $AS(GGGGS)_2$ (SEQ ID NO:1684) and $((KEAAA)_3KELAA)_2$ (SEQ ID NO:1685). In one particular embodiment, said linker is $AS(GGGGS)_2$ (SEQ ID NO:1684) or $((KEAAA)_3KELAA)_2$ (SEQ ID NO:1685). In one embodiment, said fusion protein or conjugate comprising a linker comprises a polypeptide having an amino acid sequence as set out in SEQ ID NO:1639-1658. In particular, an exemplary fusion protein or conjugate comprising the linker AS(GGGGS)$_2$ is set out in the amino acid sequence of SEQ ID NO:1646-1658, such as SEQ ID NO:1648 and 1657.

In further aspects of the present disclosure, there is provided a polynucleotide encoding an IL-1R-I binding polypeptide or a fusion protein as described herein; an expression vector comprising said polynucleotide; and a host cell comprising said expression vector.

Also encompassed by this disclosure is a method of producing a polypeptide or fusion protein as described above, comprising culturing said host cell under conditions permissive of expression of said polypeptide from its expression vector, and isolating the polypeptide.

The IL-1R-I binding polypeptide of the present disclosure may alternatively be produced by non-biological peptide synthesis using amino acids and/or amino acid derivatives having protected reactive side-chains, the non-biological peptide synthesis comprising
  step-wise coupling of the amino acids and/or the amino acid derivatives to form a polypeptide according to the first aspect having protected reactive side-chains,
  removal of the protecting groups from the reactive side-chains of the polypeptide, and
  folding of the polypeptide in aqueous solution.

It should be understood that the IL-1R-I binding polypeptide according to the present disclosure may be useful as a therapeutic, diagnostic or prognostic agent in its own right or as a means for targeting other therapeutic or diagnostic agents, with e.g. direct or indirect effects on IL-1R-I. A direct therapeutic effect may for example be accomplished by inhibiting IL-1R-I signaling.

Thus, in another aspect, there is provided a composition comprising an IL-1R-I binding polypeptide, fusion protein or conjugate as described herein and at least one pharmaceutically acceptable excipient or carrier. In one embodiment, said composition further comprises at least one additional active agent, such as at least two additional active agents, such as at least three additional active agents. Non-limiting examples of additional active agents that may prove useful in such combination are immune response modifying agents and anti-cancer agents as described herein. In one embodiment, said composition comprises a fusion protein or conjugate wherein said desired biological activity is an in vivo half-life increasing activity such that said second moiety increases in vivo half-life of the fusion protein or conjugate. Examples of moieties providing such half-life increasing activities are disclosed elsewhere herein.

Hence, in another aspect of the present disclosure, there is provided an IL-1R-I binding polypeptide, fusion protein, conjugate or composition as described herein for use as a medicament, a prognostic agent or a diagnostic agent. In one embodiment, said IL-1R-I binding polypeptide is provided for use as a medicament.

In one embodiment, there is provided an IL-1R-I binding polypeptide, fusion protein or conjugate or composition as described herein, for use as a medicament to modulate IL-1R-I function in vivo. As used herein, the term "modulate" refers to changing the activity, such as rendering IL-1R-I function hypomorph, partially inhibiting or fully inhibiting IL-1R-I function.

In one embodiment, there is provided an IL-1R-I binding polypeptide, fusion protein or conjugate or composition as described herein, for use, in the treatment, prognosis or diagnosis of an IL-1R-I related disorder.

As used herein, the term "IL-1R-I related disorder" refers to any disorder, disease or condition in which IL-1R-I plays a regulatory role in the signaling pathway. Thus, in one embodiment, there is provided an IL-1R-I binding polypeptide, fusion protein or conjugate or composition as described herein, for use in the treatment of an IL-1R-I related disorder, such as a disorder selected from the group consisting of inflammatory disease, auto-inflammatory syndrome, autoimmune disease, infectious disease, cardiovascular disease, ischaemic disease, cancer and diabetes. In one embodiment, said IL-1R-I related disorder is selected from the group consisting of inflammatory disease, autoinflammatory syndrome and autoimmune disease.

In one embodiment, said IL-1R-I related disorder is selected from the group consisting of familial Mediterranean fever (FMF); cryopyrin-associated periodic syndrome (CAPS); TNF receptor-associated periodic syndrome (TRAPS); hyper-IgD syndrome (HIDS); periodic fever; aphthous stomatitis; pharyngitis; adenitis (PFAPA); rheumatoid arthritis (RA), juvenile RA, juvenile idiopathic arthritis, systemic juvenile idiopathic arthritis; adult-onset Still's disease; Schnitzler syndrome; Muckle Wells Syndrome; macrophage activation syndrome; Behçet's disease; uveitis; acne vulgaris; pyoderma gangrenosum; gout; type 2 diabetes, new-onset diabetes; dry eye syndrome; hidradenitis suppurativa; neutrophilic dermatoses, in particular cytophagic histiocytic panniculitis, Weber-Christian disease, and neutrophilic panniculitis; cardiovascular disease, myocardial infarction, stroke; liver failure, kidney failure; acute lung injury; pseudogout, calcium-pyrophosphate deposition disorder, chondrocalcinosis, deficiency of the IL-1 receptor antagonist (DIRA), deficiency of the IL-36 receptor antagonist (DITRA), ADAM2 deficiency (DADA2), pyogenic arthritis, pyoderma gangrenosum and acne (PAPA) syndrome, pyoderma gangrenosum, acne and suppurative hidradenitis (PASH) syndrome, PAPA and suppurative hidradenitis (PAPASH) syndrome, autoinflammatory syndrome with lymphedema (AISLE), Phospholipase C-gamma-2 mutation autoinflammatory syndrome, NALP12-associated periodic syndrome (NAPS12), mevalonate kinase deficiency (MKD), psoriatic arthritis, reactive arthritis, ankylosing spondylitis, haemochromatosis-related arthritis, periarticular calcinosis, osteoarthritis, inflammatory osteoarthritis, hand osteoarthritis, pustular psoriasis such as generalised pustular psoriasis (GPP), palmoplantar pustulosis (PPP), acrodermatitis continua of Hallopeau (ACH); Blau syndrome; Sweet syndrome; various vasculitides such as giant-cell arteritis (GCA), polymyalgia rheumatica (PMR), Takayasu arteritis, Kawasaki disease, urticarial vasculitis, and Henoch-Schönlein purpura (HSP); neutrophilic urticaria and idiopathic cold urticaria; lichen planus; polymyositis, dermatomyositis, juvenile dermatomyositis and inclusion-body myositis; various stages of myeloma such as smoldering myeloma (SMM), indolent myeloma, Waldenstrom's macroglobulinemia, and multiple myeloma; tumor-induced cachexia; solid tumor growth; neonatal disorders such as bronchopulmonary dysplasia (prophylaxis), necrotising enterocolitis (NEC), retinopathy of prematurity (ROP), cerebral palsy due to perinatal cerebral ischemia, and infant respiratory distress syndrome (IRDS); Whipple's disease; traumatic brain injury; refractory epilepsy; systemic inflammatory response syndrome (SIRS); cutaneous lupus; Jessner-Kanof disease; amyotrophic lateral sclerosis; systemic sclerosis (scleroderma); septic shock; acute pancreatitis; chronic recurrent multifocal osteomyelitis, non-bacterial osteitis (NBO), synovitis, acne, pustulosis, hyperostosis, osteitis (SAPHO) syndrome, and Majeed syndrome; relapsing polychondritis; idiopathic recurrent pericarditis (IRP); myocarditis; Erdheim-Chester disease; juvenile xantogranuloma; islet-cell transplantation; haemodialysis-induced systemic inflammation; graft-versus-host disease; ANCA-associated glomerulonephritis and recurrent glomerulonephritis; Cogan syndrome; autoimmune inner-ear disease; chronic granulomatous disease (CGD); Castleman's disease; cardiac failure; diastolic cardiac failure; antisynthetase syndrome; acute ACL injury; acute haemorrhagic leukoencephalitis; AA amyloidosis; Di George syndrome; generalised fatigue; chronic fatigue syndrome (CFS); gulf-war illness (GWI); and narcolepsy.

In another embodiment, said IL-1R-I related disorder is cancer, such as a cancer selected from the group consisting of colon cancer, breast cancer, lung cancer, head and neck cancer, melanoma and prostate cancer.

The skilled person will appreciate that said IL-1R-I binding polypeptide, fusion protein or conjugate or a composition comprising an anti-IL-1R-I binding polypeptide, fusion protein or conjugate as described herein may be administered to a subject using standard administration techniques, including oral, topical, intravenous, intraperitoneal, subcutaneous, pulmonary, transdermal, intramuscular, intranasal, buccal, sublingual, duodenal or suppository administration. Thus, in one embodiment, there is provided an IL-1R-I binding polypeptide, fusion protein or conjugate or a composition as described herein for oral, topical, intravenous, intraperitoneal, subcutaneous, pulmonary, transdermal, intramuscular, intranasal, buccal, sublingual, duodenal or suppository administration. In one embodiment, said administration is oral, intravenous, subcutaneous or duodenal administration and in one particular embodiment, said administration is oral administration.

As used herein, the term "subject" refers to a mammalian subject, such as a human subject.

Non-limiting examples of indications where topical administration routes could be especially relevant in IL-1R-I mediated disease include ocular diseases such as dry eye disease, uveitis, scleritis, and ulcerative keratitis; dermatological diseases such as ichtyosis and generalized pustular psoriasis; pulmonary diseases such as adult respiratory distress syndrome, bronchopulmonary dysplasia, chronic obstructive pulmonary disease, asbestosis, and silicosis.

In some embodiments it may be beneficial that the polypeptide, fusion protein, conjugate or composition for use as described above, is administered repeatedly within a period of time, for example within a 24 hour period from disease onset. In one particular embodiment wherein said IL-1R-I binding polypeptide, fusion protein, conjugate or composition is administered repeatedly within a 24 hour period from disease onset, such as at least two times within a 24 hour period from disease onset, such as at least three times within a 24 hour period from disease onset, to a subject in need thereof. In yet a particular embodiment, said IL-1R-I binding polypeptide, fusion protein, conjugate or composition is administered continuously during a limited time period such as during 24 hours from disease onset. Repeated or continuous administration may be preferred when distribution to the brain is required, such as in acute treatment of stroke.

In some embodiments wherein said fusion protein or conjugate comprises a second moiety having an in vivo half-life increasing activity, said fusion protein or conjugate, or composition comprising such a fusion protein or conjugate, is administered once weekly to a subject in need thereof.

In a related aspect, there is provided a method of treatment of an IL-1R-I related disorder, comprising administering to a subject in need thereof an effective amount of an IL-1R-I binding polypeptide, fusion protein, conjugate or a composition as described herein. In a more specific embodiment of said method, the IL-1R-I binding polypeptide, fusion protein, conjugate or composition as described herein modulates IL-1R-I function in vivo.

In one embodiment, said IL-1R-I related disorder is selected from the group as defined above in connection with the previous aspect.

In some embodiments of said method of treatment, it may be beneficial that the polypeptide, fusion protein, conjugate or composition as described above, is administered repeatedly within a period of time, for example within a 24 hour period from disease onset. In one particular embodiment wherein said IL-1R-I binding polypeptide, fusion protein, conjugate or composition is administered repeatedly within a 24 hour period from disease onset, such as at least two times within a 24 hour period from disease onset, such as at least three times within a 24 hour period from disease onset, to a subject in need thereof. In yet a particular embodiment, said IL-1R-I binding polypeptide, fusion protein, conjugate or composition is administered continuously during a limited time period, such as within 24 hours from disease onset. Repeated or continuous administration may be preferred when distribution to the central nervous system is required, such as in acute treatment of stroke.

In other embodiments, of said method of treatment, said fusion protein or conjugate comprises a second moiety having an in vivo half-life increasing activity, or said composition comprises a fusion protein or conjugate comprising a second moiety having an in vivo half-life increasing activity. In such methods, said fusion protein, conjugate or composition may be administered once weekly to a subject in need thereof.

It may be beneficial to administer a therapeutically effective amount of an IL-1R-I binding polypeptide, fusion protein or conjugate or composition as described herein and at least one second drug substance, such as an immune response modulating agent as described above or an anti-cancer agent.

As used herein, the term "co-administration" encompasses both concomitant and sequential administration. Thus, in one embodiment there is provided a method as defined above further comprising co-administration of an immune response modulating agent as described above. In another embodiment there is provided a method as defined above further comprising co-administration of an anti-cancer agent as described above.

In another aspect of the present disclosure, there is provided a method of detecting IL-1R-I, comprising providing a sample suspected to contain IL-1R-I, contacting said sample with an IL-1R-I binding polypeptide, fusion protein, conjugate or a composition as described herein, and detecting the binding of the IL-1R-I binding polypeptide, fusion protein, conjugate or composition to indicate the presence of IL-1R-I in the sample. In one embodiment, said method further comprises an intermediate washing step for removing non-bound polypeptide, fusion protein, conjugate or composition, after contacting the sample.

While the invention has been described with reference to various exemplary aspects and embodiments, it will be understood by those skilled in the art that various changes may be made and equivalents may be substituted for elements thereof without departing from the scope of the invention. In addition, many modifications may be made to adapt a particular situation or molecule to the teachings of the invention without departing from the essential scope thereof. Therefore, it is intended that the invention not be limited to any particular embodiment contemplated, but that the invention will include all embodiments falling within the scope of the appended claims.

BRIEF DESCRIPTION OF THE FIGURES

FIG. 1 is a listing of the amino acid sequences of examples of IL-1R-I binding polypeptides of the present disclosure (SEQ ID NO:1-1638 and 1667-1679), albumin binding polypeptides (SEQ ID NO:1659-1661); human IgG1 Fc (SEQ ID NO:1662), human albumin (SEQ ID NO:1663) and human transferrin (SEQ ID NO:1664), examples of IL-1R-1 binding fusion polypeptides comprising said polypeptides (SEQ ID NO:1639-1658 and 1734-1737) optionally including a linker, control polypeptides (GS-hIL-1β, SEQ ID NO:1733) as well as the amino acid sequences of cynomolgus IL-1R-I-His$_6$ (SEQ ID NO:1665) and cynomolgus IL-1R-1-Fc (SEQ ID NO:1666) used for selection, screening and/or characterization for illustration of the invention. The deduced IL-1R-I binding motifs (BMs) of the IL-1R-I binding polypeptides disclosed herein extend from residue 8 to residue 36 in sequences with SEQ ID NO:1-1638 and 1667-1668 and 1670-1679. In SEQ ID NO:1669, said BM extends from residue 5 to residue 33. The amino acid sequences of the 49 amino acid residues long polypeptides (BMod) predicted to constitute the complete three-helix bundle within each of these Z variants extend from residue 7 to residue 55, except for the N-terminally truncated Z variant with SEQ ID NO:1669 wherein it extends from residue 4 to residue 52.

FIG. 2 is a diagram showing concentration-response curves for inhibition of IL-1β induced IL-6 release in NHDF cells for six anti-IL-1R-I binding fusion proteins (PS10536, SEQ ID NO:1648; PS10537, SEQ ID NO:1649; PS10534, SEQ ID NO:1646; PS10535, SEQ ID NO:1647; PS10538, SEQ ID NO:1650; PS10539, SEQ ID NO:1651). Anakinra (dotted line) was included as a reference.

FIG. 3 is a diagram showing concentration of IL-1R-I binding Z variants at 50% inhibition ($IC_{50}$) of IL-1β induced IL-6 release in human whole blood from five to ten individual donors. The median $IC_{50}$ was 0.31, 1.25 and 0.30 nM for PS10536 (SEQ ID NO:1648), PS1537 (SEQ ID NO:1649) and anakinra, respectively.

EXAMPLES

Summary

The following Examples disclose the development of novel Z variant molecules targeted to interleukin 1 receptor I (IL-1R-1) based on phage display technology. The IL-1R-I binding polypeptides described herein were sequenced, and their amino acid sequences are listed in FIG. 1 with the sequence identifiers SEQ ID NO:1-1632. Additional IL-1R-I binding polypeptides disclosed herein are listed in FIG. 1 with sequence identifiers SEQ ID NO:1633-1638 and 1667-1679. The Examples further describe the characterization of IL-1R-I binding polypeptides and in vitro functionality of said polypeptides. As used herein, the term "IL-1R-I binding Z variants" refers to 58 amino acid long IL-1R-I binding polypeptides comprising an IL-1R-I binding motif as disclosed herein.

Example 1

Selection and Screening of IL-1R-I Binding Z Variants

In this Example, human and cynomolgus IL-1R-I (hIL-1R-I and cIL-1R-1, respectively) were used as target proteins in phage display selections using a phage library of Z variants. The DNA of selected clones was sequenced, the Z variants were produced in *E. coli* as periplasmic fractions and assayed against IL-1R-I in ELISA (enzyme-linked immunosorbent assay).

Materials and Methods

Biotinylation of Target Protein:

Human IL-1R-1-Fc (hIL-1 RI-Fc Creative BioMart cat. no. IL1 RI-771H) and human IL-1R-I (hIL-1 RI, RnD Systems cat. no. 269-1R/CF) were biotinylated according to the manufacturer's recommendations at room temperature (RT) for 30 min using No-Weigh EZ-Link Sulfo-NHS-LC-Biotin (Thermo Scientific, cat. no. 21327) at a 10×molar excess. Prior to the biotinylation, a buffer exchange to phosphate buffered saline (PBS, 10 mM phosphate, 137 mM NaCl, 2.68 mM KCl, pH 7.4) was performed for hIL-1R-1-Fc using a dialysis cassette (Slide-a-lyzer 3.5 K, 3500 MWCO, Thermo Scientific, cat. no. 66333), according to the manufacturer's instructions, and hIL-1R-I was dissolved in 100 mM phosphate buffer pH 6.5. After the biotinylation, a buffer exchange to PBS was performed for both proteins, as described above.

Expression of His-Tagged Target Protein:

Expression of cynomolgus IL-1R-I-$His_6$(cIL-1R-I-$His_6$, SEQ ID NO:1665) was performed using the FreeStyle 293-F expression system (Thermo Fisher Scientific), essentially according to the manufacturer's protocol. Supernatants were harvested by centrifugation 5 days after transfection of expression vectors and stored at −70° C. The frozen supernatant from the FreeStyle 293-F cultures were thawed and filtrated (0.22 μm). The supernatant, containing the cIL-1R-I-$His_6$ was purified using affinity chromatography with an IMAC column. The purified protein was buffer exchanged to PBS. The purity of the protein was analyzed by SDS-PAGE stained with Coomassie Blue and the molecular weight was analyzed using mass spectrometry (HPLC/MS or MALDI-TOF/MS).

Phage display selection of IL-1R-I binding Z variants:

A library of random variants of protein Z displayed on bacteriophage in fusion to a wild type albumin binding domain (abbreviated ABD001, SEQ ID NO:1660) was used to select IL-1R-I binding Z variants. The library, which is denoted Zlib006Naive.II, has a size of $1.5\times10^{10}$ library members (Z variants). The construction in the phage library vector pAY02592 and the phage stock production was previously described in WO 2016/113246.

Selections against hIL-1R-I-Fc, biotinylated hIL-1R-1-Fc (b-hIL-1R-1-Fc), biotinylated hIL-1R-I (b-hIL-1R-1) and cIL-1R-I-$His_6$ (SEQ ID NO:1665) were performed in four selection cycles. In the first cycle, four selection tracks were run in parallel; 1-1 to 1-4. The selection tracks 1-1 and 1-4 were divided into two parts in cycle two, resulting in a total of six parallel tracks in round 2, 3 and 4; 2-1 to 2-9, 3-1 to 3-9 and 4-1 to 4-9, respectively, as presented in Table 2. The number of phage particles used for selections was more than 2000 times the number of eluted phage particles in the previous cycle, but a lower amount was used in selection tracks 4-1 to 4-5. Phage stock preparation, selection procedure and amplification of phage between selection cycles were performed essentially as described in WO 2009/077175 with the following exceptions 1-8. Exception 1: PBS supplemented with 10% fetal calf serum (FCS, Gibco, cat. no. 10108-165), 1.5 μM human serum albumin (HSA, Novozymes, cat. no. 230-005) and 0.1% Tween20 (Acros Organics, cat. no. 233362500) was used as selection buffer.

Figure 2:
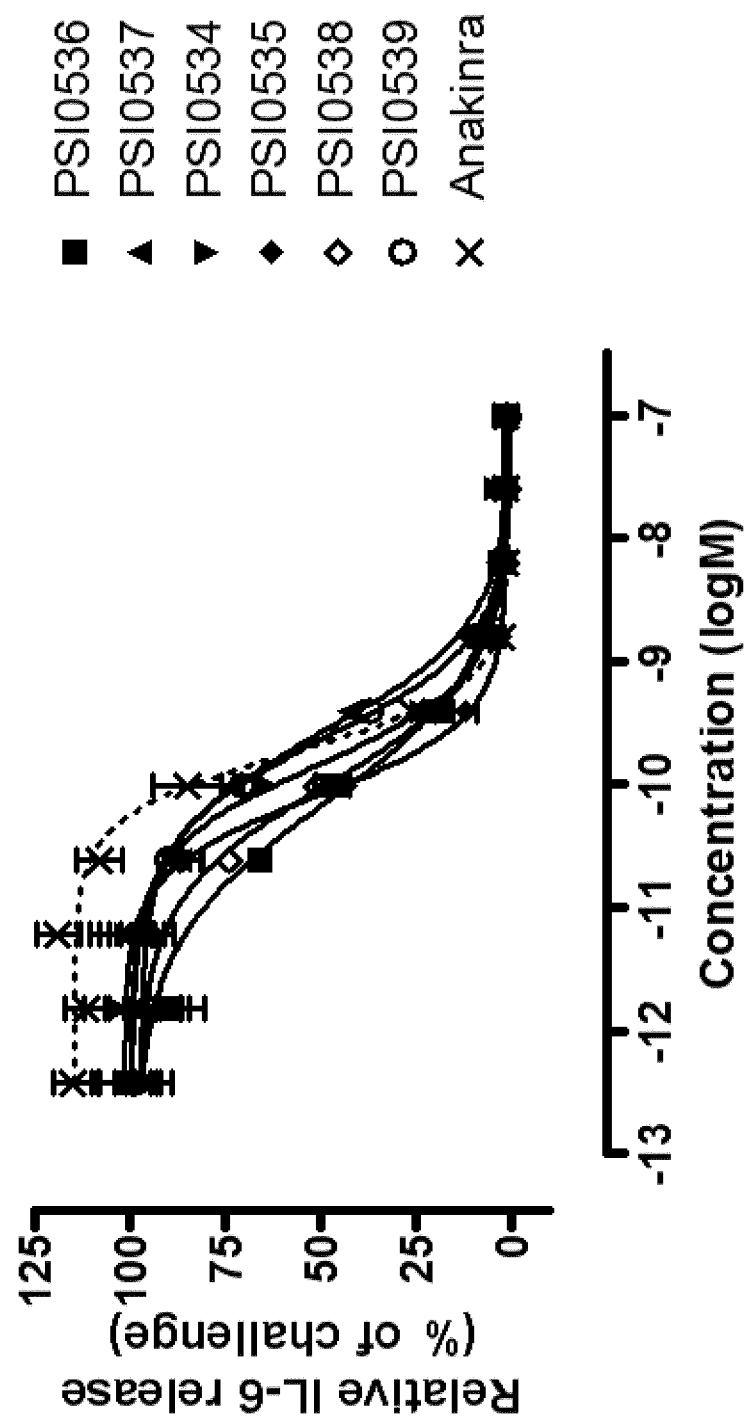

Exception 2: pre-selection was performed in cycles 1-4 at >60 min at RT or overnight at 4° C. by incubation of phage stock with Dynabeads® M-280 Streptavidin (SA beads, Life technologies/Invitrogen, cat. no. 11206D), SA beads pre-coated with biotinylated human IgG1-Fc (b-hFc, Jackson Immuno Research cat. no. 009-060-008) (Fc/SA beads), SA kanamycin, 100 μg/ml ampicillin and 2% glucose in the overnight culture.

An overview of the selection strategy, describing an increased stringency in the selection cycles obtained by using a lowered target concentration and an increased number of washes, is shown in Table 2.

TABLE 2

Overview of the phage display selection from a naive library.

| Selection Cycle | track | Phage stock from library or selection track | Preselection beads | Target | Target concentration (nM) | Number of washes |
|---|---|---|---|---|---|---|
| 1 | 1-1 | Zlib006Naive.II | Fc/Z00000/SA | hIL-1R-I-Fc | 100 | 2 |
| 1 | 1-2 | Zlib006Naive.II | Fc/protein A | hIL-1R-I-Fc | 100 | 2 |
| 1 | 1-3 | Zlib006Naive.II | Fc/SA | b-hIL-1R-I-Fc | 100 | 2 |
| 1 | 1-4 | Zlib006Naive.II | SA | b-hIL-1R-I | 100 | 2 |
| 2 | 2-1 | 1-1 | Fc/Z00000/SA | hIL-1R-I-Fc | 67 | 4 |
| 2 | 2-2 | 1-1 | Fc/Z00000/SA | hIL-1R-I-Fc | 33 | 4 |
| 2 | 2-3 | 1-2 | Fc/protein A | hIL-1R-I-Fc | 67 | 4 |
| 2 | 2-5 | 1-3 | Fc/SA | b-hIL-1R-I-Fc | 67 | 4 |
| 2 | 2-7 | 1-4 | SA | b-hIL-1R-I- | 67 | 4 |
| 2 | 2-9 | 1-4 | IM | cIL-1R-I-His$_6$ | 67 | 4 |
| 3 | 3-1 | 2-1 | Fc/Z00000/SA | hIL-1R-I-Fc | 44 | 6 |
| 3 | 3-2 | 2-2 | Fc/Z00000/SA | hIL-1R-I-Fc | 11 | 6 |
| 3 | 3-3 | 2-3 | Fc/protein A | hIL-1R-I-Fc | 44 | 6 |
| 3 | 3-5 | 2-5 | Fc/SA | b-hIL-1R-I-Fc | 44 | 6 |
| 3 | 3-7 | 2-7 | SA | b-hIL-1R-I | 44 | 6 |
| 3 | 3-9 | 2-9 | SA | b-hIL-1R-I | 44 | 6 |
| 4 | 4-1 | 3-1 | Fc/Z00000/SA | hIL-1R-I-Fc | 30 | 8 |
| 4 | 4-2 | 3-2 | Fc/Z00000/SA | hIL-1R-I-Fc | 3.7 | 8 |
| 4 | 4-3 | 3-3 | Fc/protein A | hIL-1R-I-Fc | 30 | 8 |
| 4 | 4-5 | 3-5 | Fc/SA | b-hIL-1R-I-Fc | 30 | 8 |
| 4 | 4-7 | 3-7 | SA | b-hIL-1R-I | 30 | 8 |
| 4 | 4-9 | 3-9 | IM | cIL-1R-I-His$_6$ | 30 | 8 | beads pre-coated with b-hFc and (Z00000)$_2$-Cys-biotin, prepared essentially as described in WO 2009/077175 (Fc/Z00000/SA beads), protein A beads (Life technologies/Novex, cat. no. 10002D) pre-coated with b-hFc (Fc/protein A beads) or Dynabeads® His-Tag Isolation and Pulldown (IM beads, Life Technologies/Novex, cat. no. 10104D), respectively, as presented in Table 2. b-hFc was incubated with the beads (5, 8.5 or 10 μg b-hFc per mg Z00000/SA beads, protein A beads or SA beads, respectively) for >1 h at RT, then the beads were washed with 2×PBST (PBS supplemented with 0.1% Tween20) before use in pre-selection. Exception 3: all tubes and beads used in the selections were pre-blocked with PBS supplemented with 3% BSA (bovine serum albumin, Sigma cat. no. A3059) and 0.1% Tween20. Exception 4: selections were performed in solution at RT and the time for selection was 140 min in the first cycle and 120 min in the following cycles. Exception 5: target-phage complexes were captured on beads using the following amount of target protein and beads: 3.2 μg hIL-1R-1-Fc per mg Z00000/SA beads, 4 μg hIL-1R-1-Fc per mg protein A beads, 2 μg b-hIL-1R-1-Fc or 2 μg b-hIL-1R-I per mg SA beads and 4.5 μg cIL-1R-I-His$_6$ per mg IM beads, respectively. The bead type used for each selection track is the same as presented for pre-selection in Table 2. Exception 6: E. coli strain ER2738 cells (Lucigen, Middleton, WI, USA) grown in medium supplemented with 10 μg/ml tetracycline were used for phage infection. Exception 7: a 5× excess of M13K07 helper phage compared to bacteria was allowed to infect log phase bacteria. Exception 8: amplification of phage particles after round 2 and 3 was performed essentially as described in WO 2016/113246; Example 5, but using Tryptic Soy Broth+Yeast Extract (TSB-YE) medium supplemented with 100 μM IPTG, 25 μg/ml Washes were performed for 1 min using PBST 0.1%, and elution was carried out as in the protocol for bead bound phage/target complexes eluted at pH 2 described in WO 2009/077175.

Production of Z Variants for ELISA:

The Z variants were produced essentially as described in WO 2016/113246 with the exception that the final volume of pellet dissolving from the 1 ml culture was 1000 μl PBST 0.05% (PBS supplemented with 0.05% Tween20).

The final supernatant of the periplasmic extract contained the Z variants as fusions to ABD (Z-ABD; ABD001, SEQ ID NO:1660), expressed as AQHDEALE-[Z #####]-VDYV-[ABD]-YVPG (Gronwall et al. (2007) J Biotechnol, 128: 162-183). Z ##### refers to individual 58 amino acid residue Z variants.

ELISA Screening of Z Variants:

The binding of Z variants to human IL-1R-I was analyzed in ELISA, essentially as described in WO 2016/113246, using 1 nM hIL-1R-1-Fc as target, and using a goat anti-human IgG-HRP (Southern Biotech, cat. no. 2040-05) diluted 1:10,000 for detection. As blank control, PBST 0.05% was added instead of the Z-ABD periplasmic sample and as negative control, a periplasmic extract with ABD001 (SEQ ID NO:1660) was added instead of the Z-ABD periplasmic sample. Control plates were assayed in a similar setup using 100 nM b-hFc instead of target protein and streptavidin conjugated HRP (Thermo Scientific, cat. no. N100) diluted 1:30,000 for detection.

Sequencing:

In parallel with the ELISA screening, the clones were picked for sequencing. PCR fragments, amplified from single colonies, were sequenced and analyzed essentially as described in WO 2009/077175.

EC$_{50}$ Analysis of Z Variants:

A selection of IL-1R-I binding Z variants was subjected to an analysis of response against a dilution series of hIL-1R-1-Fc using ELISA as described above. The target protein hIL-1R-1-Fc was diluted stepwise 1:10 from 100 to 0.01 nM. As a background control, the Z variants were assayed with no target protein added. Obtained data was analyzed using GraphPad Prism 5 and non-linear regression, and the EC$_{50}$ values (the half maximal effective concentration) were calculated.

Results

Phage Display Selection of IL-1R-I Binding Z Variants:

Individual clones were obtained after four cycles of phage display selections against human and cynomolgus IL-1R-1.

ELISA Screening of Z Variants:

The clones obtained after four cycles of selection were produced individually in 96-well plates and were screened for hIL-1R-1-Fc binding activity in ELISA using 1 nM target protein. In parallel, an ELISA to exclude Fc binding was run. Clones positive to hIL-1R-I were identified and none of the IL-1R-I positive clones were positive to Fc solely. No response was obtained for the ABD negative control. 45 identified Z variants displayed an ELISA screening result that was more than 0.71 AU (8.5× the control background).

Sequencing:

In parallel with ELISA screening, sequencing was performed for clones obtained after four cycles of selection. Each variant was given a unique identification number #####, and individual variants are referred to as Z #####. The amino acid sequences of a subset of the identified 58 amino acid residues long Z variants are listed in FIG. 1 and in the sequence listing as SEQ ID NO:1-19. The deduced IL-1R-I binding motifs extend from residue 8 to residue 36 in each sequence. The amino acid sequences of the 49 amino acid residues long polypeptides predicted to constitute the complete three-helix bundle within each of these Z variants extend from residue 7 to residue 55.

EC$_{50}$ Analysis of Z Variants:

A subset of said Z variants (SEQ ID NO:1-19) was subjected to an ELISA target titration using hIL-1R-I-Fc. Obtained results were used for calculation of EC$_{50}$ values (Table 3).

TABLE 3

Calculated EC$_{50}$ values from ELISA titration analysis.

| Z variant | SEQ ID NO | EC$_{50}$ (M) |
|---|---|---|
| Z12884 | 13 | $6.4 \times 10^{-10}$ |
| Z12891 | 19 | $2.2 \times 10^{-9}$ |
| Z12895 | 12 | $2.3 \times 10^{-10}$ |
| Z12905 | 7 | $7.3 \times 10^{-9}$ |
| Z12910 | 11 | $2.3 \times 10^{-10}$ |
| Z12911 | 18 | $3.2 \times 10^{-10}$ |
| Z12912 | 10 | $3.9 \times 10^{-10}$ |
| Z12915 | 5 | $4.3 \times 10^{-9}$ |
| Z12917 | 15 | $3.3 \times 10^{-10}$ |
| Z12920 | 14 | $6.6 \times 10^{-9}$ |
| Z12922 | 3 | $2.9 \times 10^{-9}$ |
| Z12929 | 17 | $1.7 \times 10^{-8}$ |
| Z12933 | 2 | $1.5 \times 10^{-9}$ |
| Z12941 | 4 | $4.6 \times 10^{-10}$ |
| Z12961 | 16 | $2.9 \times 10^{-10}$ |
| Z12964 | 1 | $3.9 \times 10^{-10}$ |
| Z12967 | 9 | $1.7 \times 10^{-10}$ |
| Z12974 | 8 | $2.1 \times 10^{-10}$ |
| Z12975 | 6 | $2.6 \times 10^{-10}$ |

Example 2

Production and Characterization of Primary IL-1R-1 Binding Z Variants

This Example describes the general procedure for subcloning and production of His-tagged Z variants originating from the primary phage selection, characterization of their target binding, target blocking and melting points.

Materials and Methods

Subcloning of Z Variants with a His$_6$ Tag:

The DNA of respective Z variant was amplified from the phage library vector pAY02592. A subcloning strategy for construction of monomeric Z variant molecules with N-terminal His$_6$ tag was applied using standard molecular biology techniques. The Z gene fragments were subcloned into an expression vector resulting in the encoded sequence MGSSHHHHHHLQ-[Z #####]-VD.

Cultivation:

E. coli T7E2 cells (GeneBridges) were transformed with plasmids containing the gene fragment of each respective IL-1R-I binding Z variant. The resulting recombinant strains were cultivated in media supplemented with 50 µg/ml kanamycin, either at 30° C. in 50 ml scale using the EnPresso protocol (BioSilta), or at 37° C. in 930 ml TSB-YE medium. In order to induce protein expression, IPTG was added to a final concentration of 0.2 mM at OD600≈10 (EnPresso) or 2 (TSB+YE). After induction, the cultivations were incubated for 16 h (EnPresso) or 5 h (TSB+YE). The cells were harvested by centrifugation.

Purification of IL-1R-I Binding Z Variants with a His$_6$ Tag:

Approximately 1-2 g of each cell pellet was resuspended in binding buffer (20 mM sodium phosphate, 0.5 M NaCl, 20 mM imidazole, pH 7.4) supplemented with Benzonase® (Merck). After cell disruption, cell debris was removed by centrifugation and each supernatant was applied on a 1 ml His GraviTrap IMAC column (GE Healthcare). Contaminants were removed by washing with wash buffer (20 mM sodium phosphate, 0.5 M NaCl, 60 mM imidazole, pH 7.4) and the Z variants were subsequently eluted with elution buffer (20 mM sodium phosphate, 0.5 M NaCl, 500 mM imidazole, pH 7.4). After the IMAC purification, the buffer was exchanged to PBS (2.68 mM KCl, 137 mM NaCl, 1.47 mM KH$_2$PO$_4$, 8.1 mM Na$_2$HPO$_4$, pH 7.4) using PD-10 desalting columns (GE Healthcare). All Z variants were subjected to a second purification step. Each Z variant was loaded on a 1 ml Resource 15RPC column (GE Healthcare), previously equilibrated with RPC solvent A (0.1% TFA, 10% ACN, 90% water). After column wash with RPC solvent A, bound proteins were eluted with a linear gradient 0-50% RPC solvent B (0.1% TFA, 80% ACN, 20% water) for 20 ml. The buffer was then exchanged to PBS (2.68 mM KCl, 137 mM NaCl, 1.47 mM KH$_2$PO$_4$, 8.1 mM Na$_2$HPO$_4$, pH 7.4) using PD-10 desalting columns (GE Healthcare).

Protein concentrations were determined by measuring the absorbance at 280 nm, using a NanoDrop® ND-1000 spectrophotometer (Saveen Werner AB) and the extinction coefficient of the respective protein. Samples with a concentration less than approximately 1 mg/ml were concentrated using Amicon Ultra-4, Ultracel-3K (MerckMillipore). The purity was analyzed by SDS-PAGE stained with Coomassie Blue and the identity of each purified Z variant was confirmed using LC/MS analysis.

Biacore Affinity Analysis:

Affinities ($K_D$) for human and cynomolgus IL-1R-I were determined for $His_6$-tagged Z variants using a Biacore 2000 instrument (GE Healthcare). hIL-1R-I or cIL-1R-I-$His_6$ was immobilized on the carboxylated dextran layer in different flow cells of a CM5 chip (GE Healthcare, cat. no. BR100012). The immobilization was performed using amine coupling chemistry according to the manufacturer's protocol. Acetate pH 4.5 (GE Healthcare, cat. no. BR100350) was used for ligand dilution and HBS-EP (GE Healthcare, cat. no. BR100188) was used as running buffer. One flow cell surface on the chip was activated and deactivated for use as blank during analyte injections. In the kinetic experiment, HBS-EP was used as running buffer, the flow rate was 50 µl/min and the temperature was 25° C. The analytes, i.e. the Z variants, were each diluted in HBS-EP buffer to final concentrations of 40 nM and 10 nM, and were injected over the target chip surfaces for 2 min, followed by dissociation in running buffer for 8 min. Kinetic constants were calculated from the obtained sensorgrams using a 1:1 binding model, in the BiaEvaluation software 4.1 (GE Healthcare).

In Vitro IL-1β Neutralization Assay:

The TF-1 cell line proliferates in response to many different cytokines including IL-1β. This cell line was used to assess the ability of primary IL-1R1 binders to inhibit IL-1β actions. TF-1 cells were maintained in RPM11640 with L-glutamine (Lonza) supplemented with 10% FCS (Gibco), Penicillin-Streptomycin (Lonza) and 2 ng/ml rhGM-CSF (R&D Systems). Prior to use, cells were washed twice in RPM11640 without rhGM-CSF. Cells were then counted and dispensed into 96 well flat bottomed plates at a density of $3 \times 10^4$ cells per well. In separate plates, serial dilutions of the inhibitory binders; $His_6$-tagged IL-1R-I binding Z variants, with a concentration range of 400-0.1 nM, or the IL-1R-I binding protein Kineret (anakinra, Sobi), with a concentration range of 0.3-0.0003 nM, were incubated in the presence of 0.6 nM IL-1β (PeproTech). The pre-mixed complexes of the Z variant polypeptides and IL-13 were transferred to wells containing TF-1 cells. The cells were stimulated for 72 h at 37° C. in a humidified 5% $CO_2$ atmosphere. During the last four hours of incubation, 19 µl of 2× diluted CCK-8 (Fluka, Sigma Aldrich), was added per well to determine the proliferative responses. The absorbance was measured at 450 nm using a microplate reader (Victor3, Perkin Elmer). The data on cell growth was assessed by non-linear regression to a four-parameter dose-response curve, and the half maximal inhibitory concentration ($IC_{50}$) was determined using GraphPadPrism program.

Circular Dichroism (CD) Spectroscopy Analysis:

Purified $His_6$-tagged Z variants were diluted to 0.5 mg/ml in PBS. For each diluted Z variant, a CD spectrum at 250-195 nm was obtained at 20° C. In addition, a variable temperature measurement (VTM) was performed to determine the melting temperature (Tm). In the VTM, the absorbance was measured at 221 nm while the temperature was raised from 20 to 90° C., with a temperature slope of 5° C./min. A new CD spectrum was obtained at 20° C. after the heating procedure in order to study the refolding ability of the Z variants. The CD measurements were performed on a Jasco J-810 spectropolarimeter (Jasco Scandinavia AB) using a cell with an optical path length of 1 mm.

Results

Production of $His_6$-Tagged Z Variants:

The IL-1R-I binding Z variants with a $His_6$ tag were expressed as soluble gene products in *E. coli*. The amount of purified protein from approximately 1-2 g bacterial pellet was determined spectrophotometrically by measuring the absorbance at 280 nm and ranged from approximately 3 to 25 mg for the different IL-1R-I binding Z variants before RPC purification. SDS-PAGE analysis of each final protein preparation showed that these predominantly contained the IL-1R-I binding Z variant. The correct identity and molecular weight of each Z variant were confirmed by HPLC-MS analysis.

Biacore Affinity Analysis:

The interactions of $His_6$-tagged IL-1R-1-binding Z variants with human and cynomolgus IL-1R-I were analyzed in a Biacore instrument by injecting two concentrations of each Z variant over surfaces containing immobilized IL-1R-1. The calculated affinities ($K_D$) for human IL-1R-I are presented in Table 4. The strongest binder to human IL-1R-I (Z12967, SEQ ID NO:9) bound to human IL-1R-I with an affinity of $1.2 \times 10^{-9}$ M and to cynomolgus IL-1R-I with an affinity of $3.5 \times 10^{-8}$ M.

TABLE 4

Affinities for $His_6$-Z polypeptides binding to IL-1R-I.

| Z variant | SEQ ID NO | Human IL-1R-I $K_D$ (M) |
|---|---|---|
| Z12884 | 13 | $1.8 \times 10^{-8}$ |
| Z12895 | 12 | $5.5 \times 10^{-9}$ |
| Z12911 | 18 | $7.1 \times 10^{-9}$ |
| Z12917 | 15 | $8.0 \times 10^{-9}$ |
| Z12922 | 3 | $9.8 \times 10^{-9}$ |
| Z12967 | 9 | $1.2 \times 10^{-9}$ |
| Z12974 | 8 | $1.5 \times 10^{-8}$ |
| Z12975 | 6 | $8.9 \times 10^{-8}$ |

In Vitro IL-1β Neutralization Assay:

The IL-1β inhibition ability of $His_6$-tagged IL-1R-I-binding Z variants was analyzed in a TF-1 cell assay. The resulting $IC_{50}$ values are presented in Table 5.

TABLE 5

$IC_{50}$ values for $His_6$-Z polypeptides from a TF-1 cell assay.

| Z variant | SEQ ID NO | $IC_{50}$ (nM) |
|---|---|---|
| Z12884 | 13 | 27 |
| Z12895 | 12 | 7.1 |
| Z12911 | 18 | 30 |
| Z12917 | 15 | 11 |
| Z12922 | 3 | 66 |
| Z12967 | 9 | 1.1 |
| Z12974 | 8 | 60 |
| Z12975 | 6 | 35 |
| Kineret | — | 0.05 |

CD Analysis:

The CD spectra determined for the IL-1R-I binding Z variants with a $His_6$ tag showed that each had an α-helical structure at 20° C. This result was also verified in the variable temperature measurements, wherein the melting temperatures were determined (Table 6). Reversible folding was seen for all the IL-1R-I binding Z variants when overlaying spectra measured before and after heating to 90° C.

TABLE 6

Melting temperatures (Tm).

| Z variant | SEQ ID NO | Tm (° C.) |
|---|---|---|
| Z12911 | 18 | 64 |
| Z12967 | 9 | 58 |
| Z12922 | 3 | 47 |
| Z12974 | 8 | 49 |
| Z12975 | 6 | 51 |
| Z12884 | 13 | 49 |
| Z12917 | 15 | 56 |
| Z12895 | 12 | 55 |

Example 3

Design and Construction of a First Matured Library of IL-1R-1 Binding Z Variants In this Example, a matured library was constructed. The library was used for selection of further IL-1R-I binding Z variants. Selections from matured libraries are usually expected to result in binders with increased affinity (Orlova et al., (2006) Cancer Res 66(8):4339-48).

Materials and Methods

Library Design:

The library was primarily based on human IL-1R-I binding Z variants from the primary selection described in Example 1 and 2. Sequences of a subset of the Z variants derived from the primary selection are listed in FIG. 1 and in the sequence listing as SEQ ID NO:1-19. In the new library, denoted Zlib0061L-1 RI.I, ten variable positions in the Z molecule scaffold were biased towards certain amino acid residues, and three positions were kept constant. Two oligonucleotides, generated by the TRIM technology, which enables incorporation of randomized sets of trinucleotide building blocks, were ordered from Ella Biotech (Martinsried, Germany). The oligonucleotides represented helix 1 and helix 2 of the Z molecule, respectively, and contained an annealing region of 18 overlapping nucleotides. The assembled double stranded DNA sequence was: 5'-AA ATA AAT CTC GAG GTA GAT GCC AAA TAC GCC AAA GAA NNN NNN NNN GCG NNN NNN GAG ATC NNN NNN CTG CCT AAC CTC ACC NNN NNN CAA NNN NNN GCC TTC ATC NNN AAA TTA NNN GAT GAC CCA AGC CAG AGC TCA TTA TTT A-3' (SEQ ID NO:1680; designed codons are denoted NNN). The sequence encodes a partially randomized helix 1 and 2 of the Z variant amino acid sequence flanked by the restriction sites XhoI and SacI. The design for each amino acid residue of the new library, including ten variable amino acid positions (9, 10, 11, 13, 14, 17, 18, 25, 32 and 35) and three constant amino acid positions (24, 27 and 28) in the Z molecule scaffold, are displayed in Table 7. The resulting theoretical library size was $9.7 \times 10^8$ variants. An even theoretical distribution of the different amino acids was applied within each amino acid position, except from position 9, 13, 17, 18, 32 and 35, where a higher portion of selected amino acids was applied.

TABLE 7

Design of first maturation library Zlib006IL-1RI.I.

| Amino acid position in the Z variant molecule | Amino acid randomization (percentage when uneven distribution) | No. of different amino acids |
|---|---|---|
| 9 | A(30%), E, F, H, I, K, L, Q, R, S, T, V, W, Y | 14 |
| 10 | A, D, E, F, H, I, K, L, Q, R, S, T, V, W, Y | 15 |
| 11 | A, D, E, F, H, I, K, L, N, Q, R, S, T, V, W, Y | 16 |
| 13 | A, F, H, I, L, Q(20%), S, T, V, W, Y(20%) | 11 |
| 14 | A, D, E, F, H, I, K, L, M, Q, R, S, T, V, W, Y | 16 |
| 17 | F, W(20%), Y | 3 |
| 18 | A(11%), D, E, F, G, H, I, K, L, N, Q, R, S, T, V, W, Y | 17 |
| 24 | R | 1 |
| 25 | H, K, R, S | 4 |
| 27 | Y | 1 |
| 28 | T | 1 |
| 32 | A, I, L, R(70%) | 4 |
| 35 | F(80%), L(20%) | 2 |

Library Construction:

The two oligonucleotides were assembled, amplified, cloned into vector pAY02592, and transformed into E. coli ER2738, essentially as described for matured libraries in WO 2015/189430. Clones from the Zlib0061L-1 RI.I library were sequenced (as described in WO 2009/077175) in order to verify the content and to evaluate the outcome of the constructed library vis-à-vis the library design.

Preparation of Phage Stock:

A phage stock containing the phagemid library was prepared in shake flasks in two batches. Cells from a glycerol stock containing the phagemid library were inoculated in 2 and 3 l, respectively, of TSB-YE medium, supplemented with 2% glucose, 10 µg/ml tetracycline and 100 µg/ml ampicillin. The cultivations were grown at 37° C. until $OD_{600}$ reached log-phase 0.5-0.9. The cultivations were infected using a 4-10×molar excess of M13K07 helper phage and were incubated for 30 minutes at 37° C. Batch 1 cultivations were pelleted by centrifugation, dissolved in TSB-YE medium, supplemented with 100 µg/ml ampicillin, 25 µg/ml kanamycin and 0.1 mM IPTG and grown at 30° C. overnight. To batch 2 cultivation, 0.1 mM IPTG was added, followed by an incubation of 1 h at 37° C. After addition of 25 µg/ml kanamycin, the cultures were grown at 30° C. overnight. For both batches, the overnight grown cells were pelleted by centrifugation at 4,000 g and the phage particles remaining in the medium were thereafter precipitated twice in PEG/NaCl, filtered and dissolved in PBS and glycerol as described in Grönwall et al., supra. Phage stocks were stored at −80° C. until use in selection.

Results

Library Construction:

The new library Zlib0061L-1 RI.I was designed based on a set of IL-1R-I binding Z variants with verified binding properties (Example 1 and 2). The theoretical size of the designed library was $9.7 \times 10^8$ Z variants. The actual size of the library, determined by titration after transformation to E. coli ER2738 cells, was $5.6 \times 10^9$ transformants. The library quality was tested by sequencing 192 transformants and by comparing their actual sequences with the theoretical design. The contents of the actual library compared to the

Example 4

Selection and Screening of Z Variants from the First Matured Library

In this Example, human and cynomolgus IL-1R-I were used as target proteins in phage display selections using a matured phage library of Z variants. The DNA of selected clones was sequenced, the Z variants were produced in *E. coli* periplasmic fractions and assayed against IL-1R-I in ELISA and Biacore.

Materials and Methods

Expression of Target Protein:

Expression of Fc fused cynomolgus IL-1R-I (cIL-1R-I-Fc, SEQ ID NO:1666) was performed using the Expi293 expression system (Thermo Fisher Scientific), essentially according to the manufacturer's protocol. Supernatants were harvested by centrifugation 7 days after transfection of expression vectors and stored at −70° C. The frozen supernatant from the Expi293 culture were thawed and filtrated (0.22 μm). The supernatant containing the cIL-1R-I-Fc was purified using affinity chromatography with a MabSelect SuRe column. The purified protein was buffer exchanged to PBS. The purity of the protein was analyzed by SDS-PAGE stained with Coomassie Blue and the molecular weight was analyzed using mass spectrometry (HPLC/MS or MALDI-TOF/MS).

Phage Display Selection of IL-1R-1 Binding Z Variants:

The biotinylated human target proteins b-hIL-1R-I-Fc and b-hIL-1R-1, and the cynomolgus target proteins cIL-1R-I-Fc (SEQ ID NO:1666) and b-cIL-1R-I-Fc (cIL-1RI-Fc biotinylated as hIL-1R-I-Fc in Example 1), were used in phage selections using the new library of Z variant molecules described in Example 3. An overview of the selection strategy, describing the parallel selection tracks and an overall increased stringency in the selection cycles obtained by using a lowered target concentration and an increased number of washes, is shown in Table 8. The selections were performed in four to five cycles essentially as described in Example 1, with the following exceptions 1-6. Exception 1: pre-selection was performed for >60 min at RT by incubation of phage stocks with Fc/SA beads (selection tracks 1-1, 1-2, 1-4, 1-6, 1-8, 2-14 and 2-16), SA beads (selection tracks 1-3, 1-7, 1-9, 2-15 and 2-17) or Fc/protein A beads (selection track 1-5), respectively. Exception 2: the time for selection was 30-100 min as presented for each track in Table 8 Exception 3: target-phage complexes were captured on beads using the following amount of target protein and beads: 8 μg b-hIL-1R-I-Fc, 1 μg b-hIL-1R-I or 4 μg cIL-1R-I-Fc per mg SA beads, respectively, and 5 μg cIL-1R-I-Fc per mg protein A beads. In selection round 5, 2 mg SPHERO neutravidin beads (Spherotech cat. no. NVM-20-5) were used for target-phage complex capture. Exception 4: in the second final wash step of tracks 2-14, 2-15, 2-17, 3-14, 3-15 and 3-17, respectively, hIL-1R-I was added to the wash buffer in 100 times higher concentration than the target concentration of the respective track and the wash was run for 15-20 min. Exception 5: the phage/target/bead complexes of selection tracks 4-1 to 4-13 were divided into two after the bead wash procedure. Half of the samples was submitted to elution and the other half, denoted 4-1× to 4-13×, was submitted to an extra 66 h, wash step before elution. Exception 6: two selection rounds four tracks, 4-4× and 4-6×, were submitted to a fifth selection round, resulting in tracks 5-1 and 5-2, as presented in Table 8. *E. coli* XL-1 Blue cells (Agilent Technologies, cat. no. 200268), grown in medium supplemented with 10 μg/ml tetracycline, were used for phage infection and a 10× excess of M13K07 helper phage compared to bacteria was allowed to infect log phase bacteria. Amplification of phage particles after round 1 to 3 was performed essentially as described for round 2 and 3 in Example 1.

TABLE 8

Overview of selections from the first matured library.

| Cycle | Selection track | Phage stock from library or selection track | Target | Target concentration (nM) | Selection time (min) | Number of washes |
|---|---|---|---|---|---|---|
| 1 | 1-1 | Zlib006IL-1RI.I | b-hIL-1R-I-Fc | 50 | 70 | 4 |
| 1 | 1-2 | Zlib006IL-1RI.I | b-hIL-1R-I-Fc | 10 | 70 | 4 |
| 1 | 1-3 | Zlib006IL-1RI.I | b-hIL-1R-I | 50 | 70 | 4 |
| 1 | 1-4 | Zlib006IL-1RI.I | b-cIL-1R-I-Fc | 100 | 70 | 2 |
| 1 | 1-5 | Zlib006IL-1RI.I | cIL-1R-I-Fc | 100 | 70 | 2 |
| 1 | 1-6 | Zlib006IL-1RI.I | b-hIL-1R-I-Fc | 10 | 45 | 5 |
| 1 | 1-7 | Zlib006IL-1RI.I | b-hIL-1R-I | 10 | 45 | 5 |
| 1 | 1-8 | Zlib006IL-1RI.I | b-hIL-1R-I-Fc | 10 | 45 | 5 |
| 1 | 1-9 | Zlib006IL-1RI.I | b-hIL-1R-I | 10 | 45 | 5 |
| 2 | 2-1 | 1-1 | b-hIL-1R-I-Fc | 20 | 60 | 6 |
| 2 | 2-2 | 1-1 | b-hIL-1R-I-Fc | 5 | 60 | 6 |
| 2 | 2-3 | 1-2 | b-hIL-1R-I-Fc | 4 | 60 | 8 |
| 2 | 2-4 | 1-2 | b-hIL-1R-I-Fc | 4 | 60 | 12 |
| 2 | 2-5 | 1-3 | b-hIL-1R-I | 20 | 60 | 6 |
| 2 | 2-6 | 1-3 | b-hIL-1R-I | 10 | 60 | 6 |
| 2 | 2-7 | 1-3 | b-hIL-1R-I | 10 | 60 | 10 |
| 2 | 2-8 | 1-4 | b-cIL-1R-I-Fc | 50 | 60 | 4 |
| 2 | 2-9 | 1-5 | cIL-1R-I-Fc | 50 | 60 | 4 |
| 2 | 2-10 | 1-1 | b-cIL-1R-I-Fc | 100 | 60 | 2 |
| 2 | 2-11 | 1-1 | b-cIL-1R-I-Fc | 50 | 60 | 6 |
| 2 | 2-12 | 1-1 | cIL-1R-I-Fc | 100 | 60 | 2 |
| 2 | 2-13 | 1-1 | cIL-1R-I-Fc | 50 | 60 | 6 |
| 2 | 2-14 | 1-8 | b-hIL-1R-I-Fc | 2 | 30 | 10* |
| 2 | 2-15 | 1-9 | b-hIL-1R-I | 2 | 30 | 10* |

TABLE 8-continued

Overview of selections from the first matured library.

| Cycle | Selection track | Phage stock from library or selection track | Target | Target concentration (nM) | Selection time (min) | Number of washes |
|---|---|---|---|---|---|---|
| 2 | 2-16 | 1-9 | b-cIL-1R-I-Fc | 25 | 30 | 3 |
| 2 | 2-17 | 1-6/1-7 pool | b-hIL-1R-I | 2 | 30 | 10* |
| 3 | 3-1 | 2-1 | b-hIL-1R-I-Fc | 5 | 60 | 8 |
| 3 | 3-2 | 2-2 | b-hIL-1R-I-Fc | 0.5 | 60 | 8 |
| 3 | 3-3 | 2-3 | b-hIL-1R-I-Fc | 1 | 60 | 12 |
| 3 | 3-4 | 2-4 | b-hIL-1R-I-Fc | 1 | 60 | 24 |
| 3 | 3-5 | 2-5 | b-hIL-1R-I | 5 | 60 | 8 |
| 3 | 3-6 | 2-6 | b-hIL-1R-I | 1 | 60 | 8 |
| 3 | 3-7 | 2-7 | b-hIL-1R-I | 2 | 60 | 20 |
| 3 | 3-8 | 2-8 | b-cIL-1R-I-Fc | 25 | 60 | 6 |
| 3 | 3-9 | 2-9 | cIL-1R-I-Fc | 25 | 60 | 6 |
| 3 | 3-10 | 2-10 | b-hIL-1R-I-Fc | 25 | 60 | 6 |
| 3 | 3-11 | 2-11 | b-hIL-1R-I-Fc | 5 | 60 | 8 |
| 3 | 3-12 | 2-12 | b-hIL-1R-I-Fc | 25 | 60 | 6 |
| 3 | 3-13 | 2-13 | b-hIL-1R-I-Fc | 5 | 60 | 8 |
| 3 | 3-14 | 2-14 | b-hIL-1R-I-Fc | 0.5 | 40 | 16* |
| 3 | 3-15 | 2-15 | b-hIL-1R-I | 0.5 | 40 | 16* |
| 3 | 3-16 | 2-16 | b-hIL-1R-I | 2 | 40 | 9 |
| 3 | 3-17 | 2-17 | b-hIL-1R-I | 0.4 | 40 | 16* |
| 4 | 4-1 | 3-1 | b-hIL-1R-I-Fc | 1 | 40 | 10** |
| 4 | 4-2 | 3-2 | b-hIL-1R-I-Fc | 0.05 | 40 | 10** |
| 4 | 4-3 | 3-3 | b-hIL-1R-I-Fc | 0.2 | 40 | 16** |
| 4 | 4-4 | 3-4 | b-hIL-1R-I-Fc | 0.2 | 40 | 36** |
| 4 | 4-5 | 3-5 | b-hIL-1R-I | 1 | 40 | 10** |
| 4 | 4-6 | 3-6 | b-hIL-1R-I | 0.1 | 40 | 10** |
| 4 | 4-7 | 3-7 | b-hIL-1R-I | 0.4 | 40 | 30** |
| 4 | 4-8 | 3-8 | b-cIL-1R-I-Fc | 12.5 | 40 | 8** |
| 4 | 4-9 | 3-9 | cIL-1R-I-Fc | 50 | 40 | 8** |
| 4 | 4-10 | 3-10 | b-cIL-1R-I-Fc | 50 | 40 | 6** |
| 4 | 4-11 | 3-11 | b-cIL-1R-I-Fc | 10 | 40 | 12** |
| 4 | 4-12 | 3-12 | cIL-1R-I-Fc | 50 | 40 | 6** |
| 4 | 4-13 | 3-13 | cIL-1R-I-Fc | 10 | 40 | 12** |
| 4 | 4-14 | 3-14 | b-hIL-1R-I-Fc | 0.1 | 40 | 20 |
| 4 | 4-15 | 3-15 | b-hIL-1R-I | 0.1 | 40 | 20 |
| 4 | 4-16 | 3-16 | b-cIL-1R-I-Fc | 5 | 40 | 16 |
| 4 | 4-17 | 3-17 | b-hIL-1R-I | 0.2 | 40 | 16 |
| 5 | 5-1 | 4-4x | b-hIL-1R-I-Fc | 50 | 100 | 3 |
| 5 | 5-2 | 4-6x | b-hIL-1R-I | 50 | 100 | 3 |

*Addition of hIL-1R-I in the second final wash step.
**Selection track divided into two after washes. One part submitted to an extra wash, over the weekend, before elution.

In the first selection cycle, nine selection tracks were run; 1-1 to 1-9. In cycle two, some tracks were divided into two, three or six tracks and two tracks were pooled into one track, resulting in a total of 17 parallel tracks in cycle 2, 3 and 4; 2-1 to 2-17, 3-1 to 3-17 and 4-1 to 4-17, respectively. In cycle 5, two tracks were run; 5-1 and 5-2. In selection tracks 1-1 to 1-5, batch 1 of Zlib0061L-1R1.I was used, and in 1-6 to 1-9, batch 2 was used, respectively. All selection tracks are presented in Table 8. The number of phage particles used for selections was typically more than 2,000 times the number of eluted phage particles in the previous cycle.

Sequencing:

Individual clones from cycle 4 or 5 of the different selection tracks were picked for sequencing. Amplification and sequence analysis of gene fragments were performed essentially as described in Example 1.

Production of Z Variants for ELISA and Biacore Screening:

Z variants were produced essentially as described in Example 1 with the exception that the culture volume was 1.2 ml and that the periplasmic extracts were clarified by filtration using 1.2 μm 96 well filter plates (MerckMillipore cat. no. MSANLY50) after the freeze-thawing procedure. Z variants screened in Biacore were diluted five times in HBS-EP buffer.

ELISA Screening of Z Variants:

The binding of Z variants to human was analyzed in ELISA, essentially as described in Example 1, using 0.3 nM hIL-1R-1-Fc as target protein. As blank control, PBST 0.05% was added instead of the Z-ABD periplasmic extract.

$EC_{50}$ Analysis of Z Variants:

A selection of IL-1R-I binding Z variants was subjected to an analysis of response against a dilution series of hIL-1R-1-Fc using ELISA as described above. The target protein hIL-1R-1-Fc was diluted stepwise 1:10 from 100 to 0.01 nM. As a background control, the Z variants were assayed with no target protein added. Obtained data was analyzed using GraphPad Prism 5 and non-linear regression, and the $EC_{50}$ values (the half maximal effective concentration) were calculated. A periplasmic extract with Z12967 (SEQ ID NO:9) was analyzed in parallel for signal comparison.

Biacore Screening of Z Variants:

The binding of Z variants to human IL-1R-I was analyzed in a kinetic screening using a Biacore T200 instrument. A polyclonal goat anti-ABD antibody (goat anti-ABD) was immobilized on CM5 chip surfaces basically as described for other proteins in Example 2. For the kinetic screening, analytes were injected in two steps. First, a Z-ABD (ABD001, SEQ ID NO:1660) periplasmic extract was injected over the surface at 5 μl/min for 1 min. As a second step, 100 nM hIL-1R-I was injected at 30 μl/min for 2 min, followed by 2 min of dissociation in running buffer HBS-EP. Glycine-HCl pH 2.0 (cat. no. BR100355, GE Healthcare) was used for regeneration of the antibody surfaces between the cycles. The temperature of the assay was 25° C. Before performing the kinetic analyses, the signal from 100 nM hIL-1R-I injected over a reference surface containing goat anti-ABD but no Z-ABD sample was subtracted from the sensorgram of Z-ABD binding to hIL-1R-I. Rough screening affinities ($K_D$) were calculated from the reference subtracted 100 nM hIL-1R-I response using a 1:1 binding model of the BiaEvaluation software 4.1 (GE Healthcare). A periplasmic extract of Z12967 was included in the screening analysis for comparison. Periplasmic extracts of four Z variants were also submitted to a single cycle kinetics (SCK) assay, using the same setup as above, but injecting five hIL-1R-I concentrations and evaluating the data with a 1:1 model for single cycle kinetics.

Results

Phage Display Selection of IL-1R-I Binding Z Variants:

Individual clones were obtained after four or five cycles of phage display selections against human and cynomolgus IL-1R-I.

Sequencing:

Sequencing was performed for clones obtained after four or five cycles of selection. Each variant was given a unique identification number #####, and individual variants are referred to as Z #####. The amino acid sequences of the 58 amino acid residues long Z variants are listed in FIG. 1 and in the sequence listing as SEQ ID NO:20-1209. The deduced IL-1R-I binding motifs extend from residue 8 to residue 36 in each sequence. The amino acid sequences of the 49 amino acid residues long polypeptides predicted to constitute the complete three-helix bundle within each of these Z variants extend from residue 7 to residue 55. It was observed that in one sequenced Z variant (Z18557, SEQ ID NO:1205) a valine residue was present in position 12.

ELISA Screening of Z Variants:

Clones obtained after four or five cycles of selection were produced individually in 96-well plates and were screened for human IL-1R-I binding activity in ELISA. 98% of the assayed Z variants gave a positive signal of 2× the blank control or higher against 0.3 nM hIL-1R-I-Fc.

$EC_{50}$ Analysis of Z Variants:

A subset of 115 Z variants displaying results over 0.99 AU (16.5× the blank control) was subjected to ELISA target titration using hIL-1R-I-Fc. Obtained results were used for calculation of $EC_{50}$ values (Table 9). The result for Z12967 (SEQ ID NO:9) was $2.4 \times 10^{-10}$ M.

TABLE 9

Calculated $EC_{50}$ values from ELISA titration analysis.

| Z variant | SEQ ID NO | $EC_{50}$ (M) |
|---|---|---|
| Z15811 | 21 | $2.5 \times 10^{-10}$ |
| Z15813 | 23 | $3.5 \times 10^{-10}$ |
| Z15824 | 34 | $2.3 \times 10^{-10}$ |
| Z15840 | 49 | $2.5 \times 10^{-10}$ |
| Z15862 | 71 | $2.1 \times 10^{-10}$ |
| Z15876 | 1206 | $4.2 \times 10^{-10}$ |
| Z15886 | 94 | $2.6 \times 10^{-10}$ |
| Z15897 | 105 | $2.5 \times 10^{-10}$ |
| Z15923 | 131 | $2.4 \times 10^{-10}$ |
| Z15927 | 135 | $2.2 \times 10^{-10}$ |
| Z15929 | 137 | $2.4 \times 10^{-10}$ |
| Z15932 | 1207 | $2.3 \times 10^{-10}$ |
| Z15949 | 154 | $2.5 \times 10^{-10}$ |
| Z15953 | 158 | $2.1 \times 10^{-10}$ |
| Z15960 | 165 | $2.3 \times 10^{-10}$ |
| Z15961 | 166 | $2.1 \times 10^{-10}$ |
| Z15975 | 1209 | $2.4 \times 10^{-10}$ |
| Z15978 | 182 | $4.8 \times 10^{-10}$ |
| Z15987 | 191 | $2.3 \times 10^{-10}$ |
| Z15996 | 200 | $2.5 \times 10^{-10}$ |
| Z15997 | 201 | $2.5 \times 10^{-10}$ |
| Z15999 | 203 | $2.4 \times 10^{-10}$ |
| Z16000 | 204 | $2.4 \times 10^{-10}$ |
| Z16003 | 207 | $2.8 \times 10^{-10}$ |
| Z16004 | 208 | $2.5 \times 10^{-10}$ |
| Z16007 | 211 | $2.2 \times 10^{-10}$ |
| Z16008 | 212 | $2.3 \times 10^{-10}$ |
| Z16011 | 215 | $2.2 \times 10^{-10}$ |
| Z16023 | 227 | $2.1 \times 10^{-10}$ |
| Z16034 | 238 | $2.3 \times 10^{-10}$ |
| Z16041 | 245 | $2.4 \times 10^{-10}$ |
| Z16042 | 246 | $2.4 \times 10^{-10}$ |
| Z16043 | 247 | $2.3 \times 10^{-10}$ |
| Z16046 | 250 | $2.7 \times 10^{-10}$ |
| Z16048 | 252 | $2.5 \times 10^{-10}$ |
| Z16049 | 253 | $2.4 \times 10^{-10}$ |
| Z16050 | 254 | $2.3 \times 10^{-10}$ |
| Z16051 | 255 | $2.5 \times 10^{-10}$ |
| Z16053 | 257 | $2.5 \times 10^{-10}$ |
| Z16054 | 258 | $2.4 \times 10^{-10}$ |
| Z16058 | 262 | $2.3 \times 10^{-10}$ |
| Z16070 | 273 | $2.3 \times 10^{-10}$ |
| Z16072 | 275 | $2.2 \times 10^{-10}$ |
| Z16084 | 287 | $2.2 \times 10^{-10}$ |
| Z16089 | 291 | $2.4 \times 10^{-10}$ |
| Z16092 | 293 | $2.4 \times 10^{-10}$ |
| Z16093 | 294 | $2.1 \times 10^{-10}$ |
| Z16097 | 298 | $2.0 \times 10^{-10}$ |
| Z16102 | 302 | $2.8 \times 10^{-10}$ |
| Z16106 | 306 | $2.3 \times 10^{-10}$ |
| Z16116 | 316 | $2.1 \times 10^{-10}$ |
| Z16117 | 317 | $2.1 \times 10^{-10}$ |
| Z16121 | 321 | $2.3 \times 10^{-10}$ |
| Z16122 | 322 | $2.9 \times 10^{-10}$ |
| Z16127 | 325 | $2.1 \times 10^{-10}$ |
| Z16135 | 333 | $2.5 \times 10^{-10}$ |
| Z16141 | 339 | $2.8 \times 10^{-10}$ |
| Z16143 | 341 | $2.1 \times 10^{-10}$ |
| Z16155 | 351 | $2.9 \times 10^{-10}$ |
| Z16156 | 352 | $2.4 \times 10^{-10}$ |
| Z16161 | 357 | $2.5 \times 10^{-10}$ |
| Z16162 | 358 | $2.7 \times 10^{-10}$ |
| Z16163 | 359 | $1.7 \times 10^{-10}$ |
| Z16164 | 360 | $6.8 \times 10^{-10}$ |
| Z16165 | 361 | $2.2 \times 10^{-10}$ |
| Z16168 | 364 | $2.8 \times 10^{-10}$ |
| Z16169 | 365 | $1.8 \times 10^{-10}$ |
| Z16173 | 369 | $3.6 \times 10^{-10}$ |
| Z16178 | 374 | $2.4 \times 10^{-10}$ |
| Z16206 | 402 | $4.5 \times 10^{-10}$ |
| Z16207 | 403 | $2.2 \times 10^{-10}$ |
| Z16219 | 415 | $2.4 \times 10^{-10}$ |
| Z16234 | 429 | $5.4 \times 10^{-10}$ |
| Z16236 | 431 | $2.4 \times 10^{-10}$ |
| Z16241 | 436 | $4.9 \times 10^{-10}$ |
| Z16243 | 438 | $2.2 \times 10^{-10}$ |
| Z16245 | 440 | $2.2 \times 10^{-10}$ |
| Z16246 | 441 | $3.9 \times 10^{-10}$ |
| Z16255 | 449 | $1.7 \times 10^{-10}$ |
| Z16263 | 457 | $2.6 \times 10^{-10}$ |
| Z16264 | 458 | $3.0 \times 10^{-10}$ |
| Z16277 | 470 | $2.6 \times 10^{-10}$ |
| Z16301 | 494 | $2.2 \times 10^{-10}$ |
| Z16302 | 495 | $2.8 \times 10^{-10}$ |
| Z16305 | 498 | $2.2 \times 10^{-10}$ |
| Z16312 | 504 | $2.4 \times 10^{-10}$ |
| Z16319 | 511 | $3.0 \times 10^{-10}$ |

TABLE 9-continued

Calculated EC$_{50}$ values from ELISA titration analysis.

| Z variant | SEQ ID NO | EC$_{50}$ (M) |
|---|---|---|
| Z16321 | 513 | $2.7 \times 10^{-10}$ |
| Z16329 | 519 | $4.5 \times 10^{-10}$ |
| Z16341 | 531 | $1.7 \times 10^{-10}$ |
| Z16363 | 550 | $2.0 \times 10^{-10}$ |
| Z16377 | 562 | $2.1 \times 10^{-10}$ |
| Z16378 | 563 | $2.0 \times 10^{-10}$ |
| Z16388 | 573 | $2.9 \times 10^{-10}$ |
| Z16405 | 590 | $3.6 \times 10^{-10}$ |
| Z16678 | 853 | $2.4 \times 10^{-10}$ |
| Z16681 | 856 | $2.3 \times 10^{-10}$ |
| Z16688 | 863 | $2.7 \times 10^{-10}$ |
| Z16749 | 921 | $2.7 \times 10^{-10}$ |
| Z16771 | 943 | $2.4 \times 10^{-10}$ |
| Z17244 | 1147 | $4.2 \times 10^{-10}$ |
| Z17255 | 1158 | $2.5 \times 10^{-10}$ |
| Z17257 | 1160 | $4.8 \times 10^{-10}$ |
| Z17269 | 1171 | $2.7 \times 10^{-10}$ |
| Z17270 | 1172 | $3.0 \times 10^{-10}$ |
| Z17274 | 1176 | $2.1 \times 10^{-10}$ |
| Z17278 | 1180 | $2.7 \times 10^{-10}$ |
| Z17279 | 1181 | $2.8 \times 10^{-10}$ |
| Z17280 | 1182 | $2.2 \times 10^{-10}$ |
| Z17288 | 1190 | $4.2 \times 10^{-10}$ |
| Z17292 | 1194 | $2.0 \times 10^{-10}$ |
| Z17296 | 1198 | $3.2 \times 10^{-10}$ |
| Z17297 | 1199 | $2.4 \times 10^{-10}$ |
| Z18557 | 1205 | $1.9 \times 10^{-10}$ |

On average, the Z variants originating from this library (first matured library) displayed an improvement in EC$_{50}$ values by a factor 10 compared with the average EC$_{50}$ for the Z variants originating from the primary selection.

Biacore Screening of Z Variants:

A selection of IL-1R-I binding Z variants was submitted to a Biacore kinetic screening. A single concentration of hIL-1R-I was injected over each Z-ABD captured from periplasmic extracts on a sensor chip surface containing an anti-ABD antibody. The calculated screening affinities are presented in Table 10. Z16062 (SEQ ID NO:266) got the best K value ($7.6 \times 10^{-9}$ M) of the assayed binders. The K$_D$ of Z2967 was $2.5 \times 10^{-8}$ M. The four binders assayed in a S1K experiment got K$_D$ values that deviated from their respective screening kinetics affinities by 0-14%.

TABLE 10

Calculated K$_D$ values from Biacore kinetic screening.

| Z variant | SEQ ID NO | K$_D$ (M) |
|---|---|---|
| Z15824 | 34 | $9.2 \times 10^{-9}$ |
| Z15840 | 49 | $1.1 \times 10^{-8}$ |
| Z15864 | 73 | $1.6 \times 10^{-8}$ |
| Z15873 | 82 | $2.3 \times 10^{-8}$ |
| Z15876 | 1206 | $8.3 \times 10^{-9}$ |
| Z15882 | 90 | $9.0 \times 10^{-9}$ |
| Z15889 | 97 | $1.5 \times 10^{-8}$ |
| Z15897 | 105 | $1.2 \times 10^{-8}$ |
| Z15908 | 116 | $1.7 \times 10^{-8}$ |
| Z15947 | 152 | $1.1 \times 10^{-8}$ |
| Z15953 | 158 | $1.1 \times 10^{-8}$ |
| Z15972 | 177 | $1.2 \times 10^{-8}$ |
| Z15986 | 190 | $9.5 \times 10^{-9}$ |
| Z16009 | 213 | $2.0 \times 10^{-8}$ |
| Z16010 | 214 | $1.2 \times 10^{-8}$ |
| Z16011 | 215 | $1.1 \times 10^{-8}$ |
| Z16012 | 216 | $1.2 \times 10^{-8}$ |
| Z16013 | 217 | $1.8 \times 10^{-8}$ |
| Z16014 | 218 | $1.1 \times 10^{-8}$ |
| Z16015 | 219 | $1.5 \times 10^{-8}$ |
| Z16016 | 220 | $1.2 \times 10^{-8}$ |
| Z16017 | 221 | $1.8 \times 10^{-8}$ |
| Z16018 | 220 | $1.6 \times 10^{-8}$ |
| Z16019 | 223 | $1.5 \times 10^{-8}$ |
| Z16020 | 224 | $2.0 \times 10^{-8}$ |
| Z16021 | 225 | $9.6 \times 10^{-9}$ |
| Z16022 | 226 | $1.5 \times 10^{-8}$ |
| Z16023 | 227 | $9.2 \times 10^{-9}$ |
| Z16024 | 228 | $1.4 \times 10^{-8}$ |
| Z16025 | 229 | $1.9 \times 10^{-8}$ |
| Z16026 | 230 | $1.6 \times 10^{-8}$ |
| Z16027 | 231 | $1.4 \times 10^{-8}$ |
| Z16028 | 232 | $1.9 \times 10^{-8}$ |
| Z16029 | 233 | $2.1 \times 10^{-8}$ |
| Z16030 | 234 | $1.7 \times 10^{-8}$ |
| Z16031 | 235 | $2.0 \times 10^{-8}$ |
| Z16032 | 236 | $2.6 \times 10^{-8}$ |
| Z16033 | 237 | $1.9 \times 10^{-8}$ |
| Z16034 | 238 | $9.1 \times 10^{-9}$ |
| Z16035 | 239 | $1.7 \times 10^{-8}$ |
| Z16036 | 240 | $1.1 \times 10^{-8}$ |
| Z16037 | 241 | $1.4 \times 10^{-8}$ |
| Z16038 | 242 | $8.9 \times 10^{-9}$ |
| Z16039 | 243 | $1.4 \times 10^{-8}$ |
| Z16040 | 244 | $2.0 \times 10^{-8}$ |
| Z16041 | 245 | $1.0 \times 10^{-8}$ |
| Z16042 | 246 | $9.7 \times 10^{-9}$ |
| Z16043 | 247 | $8.3 \times 10^{-9}$ |
| Z16044 | 248 | $1.7 \times 10^{-8}$ |
| Z16045 | 249 | $2.0 \times 10^{-8}$ |
| Z16046 | 250 | $1.8 \times 10^{-8}$ |
| Z16047 | 251 | $1.9 \times 10^{-8}$ |
| Z16048 | 252 | $1.1 \times 10^{-8}$ |
| Z16049 | 253 | $1.4 \times 10^{-8}$ |
| Z16050 | 254 | $1.3 \times 10^{-8}$ |
| Z16051 | 255 | $1.5 \times 10^{-8}$ |
| Z16052 | 256 | $1.2 \times 10^{-8}$ |
| Z16053 | 257 | $1.1 \times 10^{-8}$ |
| Z16054 | 258 | $2.9 \times 10^{-8}$ |
| Z16055 | 259 | $1.2 \times 10^{-8}$ |
| Z16056 | 260 | $1.3 \times 10^{-8}$ |
| Z16057 | 261 | $3.3 \times 10^{-8}$ |
| Z16058 | 262 | $1.4 \times 10^{-8}$ |
| Z16059 | 263 | $1.6 \times 10^{-8}$ |
| Z16060 | 264 | $1.9 \times 10^{-8}$ |
| Z16061 | 265 | $1.2 \times 10^{-8}$ |
| Z16062 | 266 | $7.6 \times 10^{-9}$ |
| Z16063 | 267 | $1.2 \times 10^{-8}$ |
| Z16065 | 268 | $7.8 \times 10^{-9}$ |

Example 5

Production and Characterization of IL-1R-I Binding Z Variants from the First Matured Library This Example describes the general procedure for subcloning and production of His$_6$-tagged and ABD-fused Z variants (originating from the first maturation library phage selection), characterization of their IL-1R-I binding, blocking and melting points.

Materials and Methods

Subcloning of Z Variants with a His$_6$ Tag:

The DNA of the respective Z variant was amplified from the phage library vector pAY02592 and was subcloned with an N-terminal His$_6$ tag using standard molecular biology techniques essentially as described in Example 2.

Subcloning of Z Variants in Fusion with ABD:

The N terminal sequence of respective Z variant was mutated, in position 1 and 2 to amino acid residues A and E respectively, using standard molecular biology techniques. The resulting new Z variants were subcloned into an expression vector containing an ABD variant, giving the encoding sequence [Z #####]-ASGS-ABD, where the ABD variant was PP013 (SEQ ID NO:1661). Z ##### refers to individual, 58 amino acid residue long Z variants.

Cultivation:

E. coli T7E2 cells (GeneBridges) were transformed with plasmids containing the gene fragment of each respective IL-1R-I binding Z variant. The resulting recombinant strains were cultivated in media supplemented with 50 μg/ml kanamycin at 30° C. in 50 ml scale using the EnPresso protocol (BioSilta). In order to induce protein expression, IPTG was added to a final concentration of 0.2 mM at OD600≈10. After induction, the cultivations were incubated for 16 h. The cells were harvested by centrifugation.

Purification of IL-1R-I Binding Z Variants with a $His_6$ Tag:

Purification was performed essentially as described in Example 2, but without the buffer exchange between the IMAC and RPC purification steps for the majority of the samples. During RPC purification, the RPC solvent A was changed to 0.1% TFA in 100% water and the linear gradient was 0-60% RPC solvent B for 18 ml.

Purification of IL-1R-I Binding Z Variants with ABD Fusion:

Approximately 2 g of each cell pellet was re-suspended in TST-buffer (25 mM Tris-HCl, 1 mM EDTA, 200 mM NaCl, 0.05% Tween20, pH 8.0) supplemented with Benzonase® (Merck). After cell disruption and clarification by centrifugation, each supernatant was applied on a gravity flow column with 1 ml agarose immobilized with an anti-ABD ligand (produced in-house). After washing with TST-buffer and 5 mM $NH_4Ac$ pH 5.5 buffer, the ABD fused Z variants were eluted with 0.1 M HAc. The buffer of the eluate was exchanged to PBS (2.68 mM KCl, 137 mM NaCl, 1.47 mM $KH_2PO_4$, 8.1 mM $Na_2HPO_4$, pH 7.4) using PD-10 desalting columns (GE Healthcare).

Protein concentrations were determined by measuring the absorbance at 280 nm, using a NanoDrop® ND-1000 spectrophotometer (Saveen Werner AB) and the extinction coefficient of the respective protein. The purity was analyzed by SDS-PAGE stained with Coomassie Blue and the identity of each purified Z variant was confirmed using LC/MS analysis.

Biacore Kinetic Analysis:

The kinetic constants ($k_{on}$ and $k_{off}$) and affinities ($K_D$) for human and cynomolgus IL-1R-I were determined for $His_6$-tagged Z variants using a Biacore 2000 instrument (GE Healthcare). The experiment was run essentially as described in Example 2, using 100, 10 and 1 nM of the Z variants. The analyte injection time was 3 min followed by 15 min dissociation and 2×5 s glycine pH 3.0 (GE Healthcare, cat. no. BR100357), supplemented with 0.5 M NaCl, was used for regeneration of the surfaces between the cycles. Kinetic constants were calculated from the obtained sensorgrams of two or three concentrations of the respective Z variant, using a 1:1 binding model in the BiaEvaluation software 4.1 (GE Healthcare). $His_6$-tagged Z12967 was included in the assay for comparison.

In Vitro IL-1β Neutralization Assay:

$His_6$-tagged IL-1R-I specific Z variants were tested for their inhibitory capacity in the TF-1 cell assay. The assay was run as described in Example 2. The data on cell growth was assessed by non-linear regression to a four-parameter dose-response curve, and $IC_{50}$ values were determined using GraphPadPrism program. $His_6$-tagged Z12967 was included for comparison.

Circular Dichroism (CD) Spectroscopy Analysis:

CD was analyzed for $His_6$-tagged Z variants, as described in Example 2.

Results

Subcloning with $His_6$ Tag:

Z variants were subcloned into constructs with an N-terminal $His_6$.

Production of $His_6$-Tagged Z Variants:

The IL-1R-I binding Z variants with a $His_6$ tag were expressed as soluble gene products in *E. coli*. The amount of purified protein was determined spectrophotometrically by measuring the absorbance at 280 nm and ranged from approximately 1 to 7 mg protein per g pellet. SDS-PAGE analysis of each final protein preparation showed that these predominantly contained the IL-1R-I binding Z variant. The correct identity and molecular weight of each Z variant were confirmed by HPLC-MS analysis.

Biacore Kinetic Analysis:

The interactions of $His_6$-tagged IL-1R-1-binding Z variants with human and cynomolgus IL-1R-I were analyzed in a Biacore instrument by injecting various concentrations of the Z variants over a surface containing immobilized IL-1R-1. A summary of the calculated kinetic parameters ($K_D$, $k_{on}$ and $k_{off}$) for the human IL-1R-I binding is given in Table 11. The strongest binder to human IL-1R-1, Z18557 (SEQ ID NO:1205), got a $K_D$ of $1.5\times10^{-10}$ against human IL-1R-I and $7.6\times10^{-9}$ M against cynomolgus IL-1R-1. The $K_D$ of Z12967 to human IL-1R-I was $5.1\times10^{-10}$ M.

TABLE 11

Kinetic parameters and affinities for $His_6$-Z polypeptides binding to human IL-1R-I.

| Z variant | SEQ ID NO | $k_{on}$ (1/Ms) | $k_{off}$ (1/s) | $K_D$ (M) |
|---|---|---|---|---|
| Z15862 | 71 | $2.8 \times 10^6$ | $1.9 \times 10^{-3}$ | $6.7 \times 10^{-10}$ |
| Z15876 | 1206 | $2.1 \times 10^6$ | $1.3 \times 10^{-3}$ | $6.2 \times 10^{-10}$ |
| Z15927 | 135 | $2.4 \times 10^6$ | $1.2 \times 10^{-3}$ | $5.1 \times 10^{-10}$ |
| Z15953 | 158 | $6.0 \times 10^6$ | $1.5 \times 10^{-3}$ | $2.4 \times 10^{-10}$ |
| Z15961 | 166 | $4.3 \times 10^6$ | $2.0 \times 10^{-3}$ | $4.6 \times 10^{-10}$ |
| Z16007 | 211 | $2.3 \times 10^6$ | $2.1 \times 10^{-3}$ | $9.2 \times 10^{-10}$ |
| Z16023 | 227 | $5.3 \times 10^6$ | $1.5 \times 10^{-3}$ | $2.9 \times 10^{-10}$ |
| Z16043 | 247 | $2.5 \times 10^6$ | $1.1 \times 10^{-3}$ | $4.4 \times 10^{-10}$ |
| Z16062 | 266 | $2.6 \times 10^6$ | $1.1 \times 10^{-3}$ | $4.4 \times 10^{-10}$ |
| Z16065 | 268 | $6.9 \times 10^6$ | $1.3 \times 10^{-3}$ | $1.9 \times 10^{-10}$ |
| Z16072 | 275 | $4.6 \times 10^6$ | $2.2 \times 10^{-3}$ | $4.7 \times 10^{-10}$ |
| Z16093 | 294 | $5.6 \times 10^6$ | $1.4 \times 10^{-3}$ | $2.5 \times 10^{-10}$ |
| Z16097 | 298 | $3.1 \times 10^6$ | $1.5 \times 10^{-3}$ | $4.8 \times 10^{-10}$ |
| Z16116 | 316 | $2.6 \times 10^6$ | $2.3 \times 10^{-3}$ | $8.8 \times 10^{-10}$ |
| Z16117 | 317 | $4.0 \times 10^6$ | $2.7 \times 10^{-3}$ | $6.9 \times 10^{-10}$ |
| Z16127 | 325 | $6.7 \times 10^6$ | $1.9 \times 10^{-3}$ | $2.9 \times 10^{-10}$ |
| Z16143 | 341 | $3.1 \times 10^6$ | $1.6 \times 10^{-3}$ | $5.3 \times 10^{-10}$ |
| Z16163 | 359 | $3.5 \times 10^6$ | $2.0 \times 10^{-3}$ | $5.5 \times 10^{-10}$ |
| Z16165 | 361 | $2.1 \times 10^6$ | $3.6 \times 10^{-3}$ | $1.7 \times 10^{-9}$ |
| Z16169 | 365 | $2.6 \times 10^6$ | $1.0 \times 10^{-3}$ | $3.9 \times 10^{-10}$ |
| Z16219 | 415 | $2.5 \times 10^6$ | $5.6 \times 10^{-3}$ | $2.2 \times 10^{-9}$ |
| Z16245 | 440 | $2.7 \times 10^6$ | $3.1 \times 10^{-3}$ | $1.2 \times 10^{-9}$ |
| Z16255 | 449 | $3.0 \times 10^6$ | $3.1 \times 10^{-3}$ | $1.0 \times 10^{-9}$ |
| Z16301 | 494 | $3.1 \times 10^6$ | $2.1 \times 10^{-3}$ | $6.6 \times 10^{-10}$ |
| Z16341 | 531 | $3.0 \times 10^6$ | $1.6 \times 10^{-3}$ | $5.2 \times 10^{-10}$ |
| Z16363 | 550 | $3.2 \times 10^6$ | $1.8 \times 10^{-3}$ | $5.7 \times 10^{-10}$ |
| Z16377 | 562 | $2.1 \times 10^6$ | $1.1 \times 10^{-3}$ | $5.4 \times 10^{-10}$ |
| Z16378 | 563 | $6.6 \times 10^6$ | $3.6 \times 10^{-3}$ | $5.5 \times 10^{-10}$ |
| Z16681 | 856 | $3.6 \times 10^6$ | $5.0 \times 10^{-3}$ | $1.4 \times 10^{-9}$ |
| Z17274 | 1176 | $1.1 \times 10^7$ | $2.4 \times 10^{-3}$ | $2.2 \times 10^{-10}$ |
| Z17280 | 1182 | $2.4 \times 10^6$ | $5.3 \times 10^{-3}$ | $2.2 \times 10^{-9}$ |
| Z17292 | 1194 | $1.3 \times 10^7$ | $5.0 \times 10^{-3}$ | $3.8 \times 10^{-10}$ |
| Z18557 | 1205 | $4.4 \times 10^6$ | $6.7 \times 10^{-4}$ | $1.5 \times 10^{-10}$ |

In Vitro IL-1β Neutralization Assay:

The IL-1β inhibition ability of His$_6$-tagged IL-1R-1-binding Z variants was analyzed in a TF-1 cell assay. The resulting IC$_{50}$ values are presented in Table 12. Z18557 (SEQ ID NO:1205) displayed the best inhibition capacity with an IC$_{50}$ value below 0.5 nM. The IC$_{50}$ of Z12967 was 5.2 nM.

TABLE 12

IC$_{50}$ values for His$_6$-Z polypeptides from a TF-1 cell assay.

| Z variant | SEQ ID NO | IC$_{50}$ (nM) |
|---|---|---|
| Z15862 | 71 | 6.6 |
| Z15876 | 1206 | 2.4 |
| Z15927 | 135 | 2.5 |
| Z15953 | 158 | 3.7 |
| Z15961 | 166 | 2.9 |
| Z16007 | 211 | 5.9 |
| Z16023 | 227 | 3.8 |
| Z16043 | 247 | 2.5 |
| Z16062 | 266 | 1.8 |
| Z16065 | 268 | 1.7 |
| Z16072 | 275 | 4.3 |
| Z16093 | 294 | 3.3 |
| Z16097 | 298 | 3.4 |
| Z16116 | 316 | 4.1 |
| Z16117 | 317 | 8.5 |
| Z16127 | 325 | 4.1 |
| Z16143 | 341 | 4.8 |
| Z16163 | 359 | 1.8 |
| Z16165 | 361 | 11.5 |
| Z16169 | 365 | 0.76 |
| Z16219 | 415 | 24.2 |
| Z16245 | 440 | 8.2 |
| Z16255 | 449 | 8.5 |
| Z16301 | 494 | 4.5 |
| Z16341 | 531 | 3.9 |
| Z16363 | 550 | 8.1 |
| Z16377 | 562 | 3.1 |
| Z16378 | 586 | 32.7 |
| Z16681 | 856 | 20.1 |
| Z17274 | 1176 | 4.6 |
| Z17280 | 1182 | 5.4 |
| Z17292 | 1194 | 13.2 |
| Z18557 | 1205 | <0.5 |

CD Analysis:

The CD spectra determined for the IL-1R-I binding Z variants with a His$_6$ tag showed that each had an α-helical structure at 20° C. This result was also verified in the variable temperature measurements, wherein melting temperatures were determined (Table 13). Reversible folding was seen for all the IL-1R-I binding Z variants when overlaying spectra measured before and after heating to 90° C.

TABLE 13

Melting temperatures (Tm).

| Z variant | SEQ ID NO | Tm (° C.) |
|---|---|---|
| Z15876 | 1206 | 55 |
| Z15927 | 135 | 56 |
| Z15953 | 158 | 56 |
| Z15961 | 166 | 59 |
| Z16023 | 227 | 60 |
| Z16043 | 247 | 54 |
| Z16062 | 266 | 54 |
| Z16065 | 268 | 59 |
| Z16093 | 294 | 52 |
| Z16097 | 298 | 56 |
| Z16116 | 316 | 59 |
| Z16117 | 317 | 63 |
| Z16127 | 325 | 59 |
| Z16163 | 359 | 57 |
| Z16169 | 365 | 48 |
| Z16245 | 440 | 63 |
| Z16341 | 531 | 59 |
| Z16377 | 562 | 52 |
| Z16681 | 856 | 68 |
| Z17280 | 1182 | 62 |
| Z18557 | 1205 | 60 |

Example 6

Design and Construction of Two Second Matured Libraries of IL-1R-I Binding Z Variants In this Example, two second matured libraries were constructed. The libraries were used for selections of additional IL-1R-I binding Z variants.

Materials and Methods

Library Design:

The libraries were primarily based on sequences of human IL-1R-I binding Z variants described in Example 4 and 5. In the new libraries, denoted Zlib0061L-1 RI.II and Zlib0061L-1 RI.III, 10 variable positions in the Z molecule scaffold were biased towards certain amino acid residues and three positions were kept constant, respectively, according to a strategy mainly based on Z variants (SEQ ID NO:19-1209) from the selection from the first matured library. In addition, in both libraries, a new amino acid position was included for variation; position 12 of the 58 aa Z variant sequence, resulting in 11 variable positions, in total. Position 12 of Z18557 (SEQ ID NO:1205), characterized in Example 5, was valine. The library design allowed for the amino acids A, V and I in position 12.

For Zlib0061L-1 RI.II, a DNA linker was generated using split-pool synthesis containing the following sequence ordered from DNA 2.0 (Menlo Park, CA, USA): 5'-AA ATA AAT CTC GAG GTA GAT GCC AAA TAC GCC AAA GAA NNN NNN NNN NNN NNN NNN GAG ATC NNN NNN CTG CCT AAC CTC ACC NNN NNN CAA NNN NNN GCC TTC ATC NNN AAA TTA NNN GAT GAC CCA AGC CAG AGC TCA TTA TTT A-3' (SEQ ID NO:1681, designed codons are denoted NNN). The design for each amino acid residue of the new library, including eleven variable amino acid positions (9, 10, 11, 12, 13, 14, 17, 18, 25, 28 and 35) and three constant amino acid positions (24, 27 and 32) in the Z molecule scaffold, are displayed in Table 14. The resulting theoretical library size was 2.2×10$^7$ variants. An even theoretical distribution of the different amino acids was applied within each amino acid position, except from position 10, 11, 12, 13, 17, 28 and 35, where a higher portion of selected amino acids was applied.

For Zlib0061L-1 RI.III, the library was constructed similarly as Zlib0061L-1 RI.I, described in Example 3, using the TRIM technology. The DNA sequence, 5'-AA ATA AAT CTC GAG GTA GAT GCC AAA TAC GCC AAA GAA NNN NNN NNN NNN NNN NNN GAG ATC NNN NNN CTG CCT AAC CTC ACC NNN NNN CAA NNN NNN GCC TTC ATC NNN AAA TTA NNN GAT GAC CCA AGC CAG AGC TCA TTA TTT A-3 (SEQ ID NO:1682, designed codons are denoted NNN) was ordered from Ella Biotech (Martinsried, Germany). The design for each amino acid residue of the new library, including eleven variable amino acid positions (9, 10, 11, 12, 13, 14, 17, 18, 25, 32 and 35) and three constant amino acid positions (24, 27 and 28) in the Z molecule scaffold, are displayed in Table 15. The resulting theoretical library size was $1.0 \times 10^8$ variants. An even theoretical distribution of the different amino acids was applied within each amino acid position, except from position 10, 11, 12, 32 and 35, where a higher portion of selected amino acids was applied.

TABLE 14

Zlib006IL-1RI.II library design, second maturation.

| Amino acid position in the Z variant molecule | Amino acid randomization (percentage when uneven distribution) | No. of different amino acids |
|---|---|---|
| 9 | A, E, I, L, T, V | 6 |
| 10 | E(50%), I, L, R, V, Y | 6 |
| 11 | A, E(27%), I, K, Q, R, T, V, Y | 9 |
| 12 | A(50%), I, V | 3 |
| 13 | A, I, L, Q(50%), V, Y | 6 |
| 14 | F, M, Q, W, Y | 5 |
| 17 | F(70%), Y(30%) | 2 |
| 18 | A, D, E, F, G, H, I, K, L, Q, R, S, T, V, W, Y | 16 |
| 24 | R | 1 |
| 25 | K, R | 2 |
| 27 | Y | 1 |
| 28 | I, T(71.4%), V | 3 |
| 32 | R | 1 |
| 35 | F(25%), I(12.5%), L(50%), Y(12.5%) | 4 |

TABLE 15

Zlib006IL-1RI.III library design, second maturation.

| Amino acid position in the Z variant molecule | Amino acid randomization (percentage when uneven distribution) | No. of different amino acids |
|---|---|---|
| 9 | A, E, I, L, T, V | 6 |
| 10 | E(60%), I, V | 3 |
| 11 | A, D, E(15%), F, H, I, K, L, Q, R, S, T, V, W, Y | 15 |
| 12 | A(50%), I(20%), V(30%) | 3 |
| 13 | A, E, F, H, I, K, L, Q, R, S, T, V, W, Y | 14 |
| 14 | A, E, F, H, I, K, L, Q, R, S, T, V, W, Y | 14 |
| 17 | F, I, L, W, Y | 5 |
| 18 | A, D, E, F, G, H, I, K, L, Q, R, S, T, V, W, Y | 16 |
| 24 | R | 1 |
| 25 | K, R | 2 |
| 27 | Y | 1 |
| 28 | T | 1 |
| 32 | I(10%), R(90%) | 2 |
| 35 | F(30%), L(70%) | 2 |

Library Construction and Phage Stock Preparation:

Zlib0061L-1 RI.II and Zlib0061L-1RI.III were constructed as described in WO 2016/113246 (Example 4) and in Example 3, respectively. For both libraries, *E. coli* XL-1 Blue was used for library transformation. Clones from the libraries of Z variants were sequenced (as described in Example 3) in order to verify the content and to evaluate the outcome of the constructed library vis-à-vis the library design.

Phage stocks containing the phagemid libraries were prepared in shake flasks. Cells from glycerol stocks containing the phagemid library were inoculated in 0.5 or 1 l, respectively, of TSB-YE medium, essentially as described for Zlib0061L-1 RI.I batch 2 in Example 3. The cultivations were infected using a 10-20× molar excess of M13K07 helper phage at an $OD_{600}$ of 0.8-0.9. Phage stocks were prepared as described in Example 3.

Results

Library Construction:

The new libraries were designed based on a set of IL-1R-I binding Z variants, selected from Zlib0061L-1 RI.I, with verified binding properties (Examples 4 and 5). The theoretical sizes of Zlib0061L-1 RI.II and Zlib0061L-1 RI.III were $2.2 \times 10^7$ and $1.0 \times 10^8$ Z variants, respectively. The actual sizes of the libraries, determined by titration after transformation to *E. coli* XL-1 Blue cells, were $1.2 \times 10^9$ and $7.0 \times 10^9$ transformants, respectively.

The library qualities were tested by sequencing of 192 and 96 transformants from Zlib0061L-1 RI.II and Zlib0061L-1 RI.III, respectively, and by comparing their actual sequences with the theoretical design. The contents of the actual library compared to the designed library were shown to be satisfactory. Two matured libraries of potential binders to IL-1R-I were thus successfully constructed.

Example 7

Selection of Z Variants from the Second Matured Libraries

In this Example, human and cynomolgus IL-1R-I were used as target proteins in phage display selections using two second matured phage libraries of Z variants.

Materials and Methods

Phage Display Selection of IL-1R-I Binding Z Variants:

The biotinylated human target proteins b-hIL-1R-I-Fc and b-hIL-1R-I, and the cynomolgus target protein b-IL-1R-I-Fc, were used in phage selections using the new libraries of Z variant molecules described in Example 6. An overview of the selection strategy, describing the parallel selection tracks and an overall increased stringency in the selection cycles obtained by using a lowered target concentration and an increased number of washes, is shown in Table 16.

TABLE 16

Overview of selections from the two second matured libraries.

| Cycle | Selection track | Phage stock from library or selection track | Target | Target concentration (nM) | Selection time (min) | Number of washes |
|---|---|---|---|---|---|---|
| 1 | 1-1 | Zlib006IL-1RI.II | b-hIL-1R-I-Fc | 10 | 45 | 5 |
| 1 | 1-2 | Zlib006IL-1RI.II | b-hIL-1R-I | 10 | 45 | 5 |
| 1 | 1-3 | Zlib006IL-1RI.II | b-cIL-1R-I-Fc | 25 | 45 | 3 |
| 1 | 1-4 | Zlib006IL-1RI.III | b-hIL-1R-I-Fc | 20 | 45 | 5 |
| 1 | 1-5 | Zlib006IL-1RI.III | b-hIL-1R-I | 20 | 45 | 5 |

TABLE 16-continued

Overview of selections from the two second matured libraries.

| Selection Cycle | Selection track | Phage stock from library or selection track | Target | Target concentration (nM) | Selection time (min) | Number of washes |
|---|---|---|---|---|---|---|
| 1 | 1-6 | Zlib006IL-1RI.III | b-cIL-1R-I-Fc | 50 | 45 | 3 |
| 1 | 1-7 | Zlib006IL-1RI.II | b-hIL-1R-I-Fc | 10 | 45 | 5 |
| 1 | 1-8 | Zlib006IL-1RI.II | b-hIL-1R-I | 10 | 45 | 5 |
| 1 | 1-9 | Zlib006IL-1RI.II | b-cIL-1R-I-Fc | 25 | 45 | 3 |
| 1 | 1-10 | Zlib006IL-1RI.III | b-hIL-1R-I-Fc | 20 | 45 | 5 |
| 1 | 1-11 | Zlib006IL-1RI.III | b-hIL-1R-I | 20 | 45 | 5 |
| 1 | 1-12 | Zlib006IL-1RI.III | b-cIL-1R-I-Fc | 50 | 45 | 3 |
| 2 | 2-1 | 1-1 | b-hIL-1R-I-Fc | 1 | 30 | 10* |
| 2 | 2-2 | 1-2 | b-hIL-1R-I | 2 | 30 | 10 |
| 2 | 2-3 | 1-2 | b-hIL-1R-I | 1 | 30 | 10 |
| 2 | 2-4 | 1-2 | b-hIL-1R-I | 1 | 30 | 10* |
| 2 | 2-5 | 1-3 | b-hIL-1R-I | 10 | 30 | 8 |
| 2 | 2-6 | 1-4 | b-hIL-1R-I-Fc | 4 | 30 | 8 |
| 2 | 2-7 | 1-5 | b-hIL-1R-I | 4 | 30 | 8 |
| 2 | 2-8 | 1-5 | b-hIL-1R-I | 2 | 30 | 10 |
| 2 | 2-9 | 1-5 | b-hIL-1R-I | 2 | 30 | 10* |
| 2 | 2-10 | 1-6 | b-hIL-1R-I | 20 | 30 | 6 |
| 2 | 2-11 | 1-7/1-8/1-9 pool | b-hIL-1R-I | 1 | 30 | 10* |
| 2 | 2-12 | 1-10/1-11/1-12 pool | b-hIL-1R-I | 2 | 30 | 10* |
| 3 | 3-1 | 2-1 | b-hIL-1R-I-Fc | 0.4 | 40 | 16* |
| 3 | 3-2 | 2-2 | b-hIL-1R-I | 0.4 | 40 | 15 |
| 3 | 3-3 | 2-3 | b-hIL-1R-I | 0.1 | 40 | 20 |
| 3 | 3-4 | 2-4 | b-hIL-1R-I | 0.1 | 40 | 16* |
| 3 | 3-5 | 2-5 | b-cIL-1R-I-Fc | 5 | 40 | 12 |
| 3 | 3-6 | 2-6 | b-hIL-1R-I-Fc | 0.8 | 40 | 12 |
| 3 | 3-7 | 2-7 | b-hIL-1R-I | 0.8 | 40 | 12 |
| 3 | 3-8 | 2-8 | b-hIL-1R-I | 0.2 | 40 | 20 |
| 3 | 3-9 | 2-9 | b-hIL-1R-I | 0.2 | 40 | 16* |
| 3 | 3-10 | 2-10 | b-cIL-1R-I-Fc | 10 | 40 | 9 |
| 3 | 3-11 | 2-11 | b-hIL-1R-I | 0.4 | 40 | 16* |
| 3 | 3-12 | 2-12 | b-hIL-1R-I | 0.4 | 40 | 16* |
| 4 | 4-1 | 3-1 | b-hIL-1R-I-Fc | 0.125 | 40 | 20** |
| 4 | 4-2 | 3-2 | b-hIL-1R-I | 0.125 | 40 | 20 |
| 4 | 4-3 | 3-3 | b-hIL-1R-I | 0.05 | 40 | 30 |
| 4 | 4-4 | 3-4 | b-hIL-1R-I | 0.05 | 40 | 20** |
| 4 | 4-5 | 3-5 | b-hIL-1R-I | 1 | 40 | 16 |
| 4 | 4-6 | 3-6 | b-hIL-1R-I-Fc | 0.16 | 40 | 16* |
| 4 | 4-7 | 3-7 | b-hIL-1R-I | 0.16 | 40 | 16 |
| 4 | 4-8 | 3-8 | b-hIL-1R-I | 0.1 | 40 | 30 |
| 4 | 4-9 | 3-9 | b-hIL-1R-I | 0.1 | 40 | 20** |
| 4 | 4-10 | 3-10 | b-hIL-1R-I | 2 | 40 | 16 |
| 4 | 4-11 | 3-11 | b-hIL-1R-I | 0.2 | 40 | 16 |
| 4 | 4-12 | 3-12 | b-hIL-1R-I | 0.2 | 40 | 16 |

*Addition of hIL-1R-I in the second final wash step.
**Selection track divided into two before second final wash step. One part submitted to an over-night wash in the presence of hIL-1R-I and one part submitted to a 1 h wash in PBST.

The selections were performed in four cycles essentially as described in Example 4, with the following exceptions 1-3. Exception 1: pre-selection was performed in selection round 1 and 2 for >60 min at RT by incubation of phage stocks with SA beads (b-hIL-1R-I tracks) or Fc/SA beads (b-IL-i RI-Fc tracks). Exception 2: in the second final wash step of tracks 2-i, 2-4, 2-9, 2-11, 2-12, 3-i, 3-4, 3-9, 3-11 and 3-12, respectively, hIL-1R-I was added to the wash buffer in 100 times higher concentration than the target concentration of the respective track and the wash was run for 15-20 min. Exception 3: In the fourth selection round, the tracks 4-i, 4-4 and 4-6 were divided into two before the second final wash step. For one part, hIL-1R-I was added to the wash buffer in 100 times higher concentration than the target concentration of the respective track and the second final wash was run overnight. For the other part, a 1 h wash in PBST was applied for the second final wash.

In the first selection cycle, twelve selection tracks were run; 1-1 to 1-12. In cycle two, two tracks were divided into three, and six tracks were pooled into two tracks, resulting in a total of 12 parallel tracks in cycle 2, 3 and 4; 2-1 to 2-12, 3-1 to 3-12 and 4-1 to 4-12, respectively. All selection tracks are presented in Table 16. The number of phage particles used for selections was typically more than 2000 times the number of eluted phage particles in the previous cycle.

Results

Phage Display Selection of IL-1R-I Binding Z Variants:

Individual clones were obtained after four cycles of phage display selections against human and cynomolgus IL-1R-1.

Example 8

Screening of Z Variants from the First and Second Matured Libraries

In this Example, DNA of selected clones from Example 4 and Example 7 was sequenced, the Z variants were produced in *E. coli* periplasmic fractions and assayed against IL-1R-I in ELISA and Biacore.

Materials and Methods

Sequencing of Potential Binders:

Individual clones from cycle 4 of selections using the three matured libraries Zlib0061L-1 RI.I, Zlib0061L-1 RI.II and Zlib0061L-1 RI.III were picked for sequencing. Amplification and sequence analysis of gene fragments were performed essentially as described in Example 1.

Production of Z Variants for ELISA and Biacore Screening:

Z Variants were produced essentially as described in Example 4 with the exception that the periplasmic extracts were prepared by heat-treatment (82° C., 20 min) followed by clarification by filtration. Z variants screened in Biacore were diluted five times in HBS-EP buffer.

ELISA Screening of Z Variants:

The binding of Z variants to human IL-1R-I was analyzed in ELISA, essentially as described in Example 1, using 0.2 nM hIL-1R-1-Fc as target protein. As negative control, a periplasmic extract of ABD001 was used.

$EC_{50}$ Analysis of Z Variants:

A selection of IL-1R-I binding was subjected to an analysis of response against a dilution series of hIL-1R-1-Fc using ELISA as described above. The target protein hIL-1R-1-Fc was diluted stepwise 1:10 from 20 to 0.002 nM. As a background control, the Z variants were assayed with no target protein added. Obtained data was analyzed using GraphPad Prism 5 and non-linear regression, and the $EC_{50}$ values (the half maximal effective concentration) were calculated. Periplasmic extracts with Z12967, Z16065 and Z16218 (corresponding to SEQ ID:9, 268 and 414, respectively) were analyzed in parallel for signal comparison. As negative control, a periplasmic extract of ABD001 was used.

Biacore Screening of Z Variants:

The binding of Z variants to human IL-1R-I was analyzed in a kinetic screening, using a Biacore 2000 instrument, essentially as described in Example 4, but with the exception that Z-ABD (ABD001, SEQ ID NO:1660) periplasmic extracts were injected during 2 min. Periplasmic extracts of Z12967, Z16065 and Z16218 were included in the screening analysis in duplicates for comparison. A periplasmic extract with ABD (ABD001, SEQ ID NO:1660) was included as negative control.

Results

Sequencing:

Sequencing was performed for clones obtained after four cycles of selection. Each variant was given a unique identification number #####, and individual variants are referred to as Z #####. The amino acid sequences of the 58 amino acid residues long Z variants are listed in FIG. 1 and in the sequence listing as SEQ ID NO: 1210-1632. The deduced IL-1R-I binding motifs extend from residue 8 to residue 36 in each sequence. The amino acid sequences of the 49 amino acid residues long polypeptides predicted to constitute the complete three-helix bundle within each of these Z variants extend from residue 7 to residue 55.

ELISA Screening of Z Variants:

Clones obtained after four cycles of selection were produced individually in 96-well plates and were screened for human IL-1R-I binding activity in ELISA. 99.5% of the assayed Z variants gave a positive signal of 2× the blank control or higher against 0.2 nM hIL-1R-I-Fc.

$EC_{50}$ analysis of Z variants: A subset of 102 Z variants displaying results over 0.74 AU (8.2× the blank control) was subjected to ELISA target titration using hIL-1R-I-Fc. Obtained results were used for calculation of $EC_{50}$ values (Table 17). The results for Z12967, Z16065 and Z16218 were $2.6 \times 10^{-10}$, $2.1 \times 10^{-10}$ and $2.2 \times 10^{-10}$ M, respectively.

TABLE 17

Calculated $EC_{50}$ values from ELISA titration analysis.

| Z variant | SEQ ID NO | $EC_{50}$ (M) |
| --- | --- | --- |
| Z15840 | 49 | $2.3 \times 10^{-10}$ |
| Z15862 | 71 | $2.5 \times 10^{-10}$ |
| Z15876 | 1206 | $1.9 \times 10^{-10}$ |
| Z15934 | 1208 | $1.7 \times 10^{-10}$ |
| Z15945 | 150 | $2.3 \times 10^{-10}$ |
| Z15975 | 1209 | $1.9 \times 10^{-10}$ |
| Z16062 | 266 | $2.1 \times 10^{-10}$ |
| Z16183 | 379 | $2.3 \times 10^{-10}$ |
| Z16208 | 404 | $2.2 \times 10^{-10}$ |
| Z16603 | 782 | $2.2 \times 10^{-10}$ |
| Z16606 | 785 | $2.3 \times 10^{-10}$ |
| Z18754 | 1252 | $3.5 \times 10^{-10}$ |
| Z18757 | 1321 | $3.0 \times 10^{-10}$ |
| Z18758 | 1281 | $2.4 \times 10^{-10}$ |
| Z18759 | 1314 | $2.4 \times 10^{-10}$ |
| Z18760 | 1435 | $1.7 \times 10^{-10}$ |
| Z18763 | 1431 | $2.6 \times 10^{-10}$ |
| Z18766 | 1274 | $3.3 \times 10^{-10}$ |
| Z18769 | 1339 | $2.9 \times 10^{-10}$ |
| Z18770 | 1284 | $2.8 \times 10^{-10}$ |
| Z18771 | 1341 | $2.5 \times 10^{-10}$ |
| Z18774 | 1389 | $2.6 \times 10^{-10}$ |
| Z18776 | 1418 | $2.2 \times 10^{-10}$ |
| Z18777 | 1326 | $2.6 \times 10^{-10}$ |
| Z18785 | 1323 | $2.5 \times 10^{-10}$ |
| Z18786 | 1320 | $2.4 \times 10^{-10}$ |
| Z18790 | 1439 | $2.6 \times 10^{-10}$ |
| Z18799 | 1423 | $2.3 \times 10^{-10}$ |
| Z18803 | 1327 | $2.5 \times 10^{-10}$ |
| Z18804 | 1329 | $2.7 \times 10^{-10}$ |
| Z18805 | 1437 | $2.7 \times 10^{-10}$ |
| Z18806 | 1271 | $2.7 \times 10^{-10}$ |
| Z18808 | 1342 | $4.0 \times 10^{-10}$ |
| Z18810 | 1278 | $2.9 \times 10^{-10}$ |
| Z18811 | 1405 | $2.8 \times 10^{-10}$ |
| Z18813 | 1375 | $2.0 \times 10^{-10}$ |
| Z18814 | 1368 | $2.7 \times 10^{-10}$ |
| Z18819 | 1276 | $2.9 \times 10^{-10}$ |
| Z18820 | 1417 | $3.3 \times 10^{-10}$ |
| Z18824 | 1264 | $2.8 \times 10^{-10}$ |
| Z18825 | 1275 | $3.5 \times 10^{-10}$ |
| Z18826 | 1356 | $2.4 \times 10^{-10}$ |
| Z18827 | 1318 | $2.4 \times 10^{-10}$ |
| Z18831 | 1308 | $2.9 \times 10^{-10}$ |
| Z18832 | 1340 | $1.5 \times 10^{-10}$ |
| Z18834 | 1361 | $2.5 \times 10^{-10}$ |
| Z18836 | 1430 | $2.3 \times 10^{-10}$ |
| Z18838 | 1337 | $2.4 \times 10^{-10}$ |
| Z18843 | 1309 | $2.8 \times 10^{-10}$ |
| Z18846 | 1331 | $1.9 \times 10^{-10}$ |
| Z18866 | 1324 | $3.1 \times 10^{-10}$ |
| Z18874 | 1421 | $2.2 \times 10^{-10}$ |
| Z18875 | 1420 | $2.9 \times 10^{-10}$ |
| Z18877 | 1301 | $3.5 \times 10^{-10}$ |
| Z18878 | 1302 | $3.7 \times 10^{-10}$ |
| Z18879 | 1390 | $3.4 \times 10^{-10}$ |
| Z18881 | 1355 | $2.8 \times 10^{-10}$ |
| Z18882 | 1311 | $3.1 \times 10^{-10}$ |
| Z18884 | 1403 | $2.3 \times 10^{-10}$ |
| Z18886 | 1432 | $2.9 \times 10^{-10}$ |
| Z18887 | 1386 | $2.1 \times 10^{-10}$ |
| Z18888 | 1422 | $2.3 \times 10^{-10}$ |
| Z18889 | 1344 | $2.4 \times 10^{-10}$ |
| Z18890 | 1352 | $2.5 \times 10^{-10}$ |
| Z18904 | 1587 | $3.8 \times 10^{-10}$ |
| Z18908 | 1591 | $2.4 \times 10^{-10}$ |
| Z18912 | 1251 | $1.4 \times 10^{-10}$ |
| Z18917 | 1509 | $2.2 \times 10^{-10}$ |
| Z18920 | 1270 | $2.4 \times 10^{-10}$ |
| Z18966 | 1272 | $2.5 \times 10^{-10}$ |
| Z18967 | 1388 | $3.1 \times 10^{-10}$ |
| Z18968 | 1472 | $2.0 \times 10^{-10}$ |
| Z18971 | 1559 | $3.5 \times 10^{-10}$ |
| Z18982 | 1553 | $2.5 \times 10^{-10}$ |
| Z19012 | 1588 | $2.4 \times 10^{-10}$ |

TABLE 17-continued

Calculated EC$_{50}$ values from ELISA titration analysis.

| Z variant | SEQ ID NO | EC$_{50}$ (M) |
|---|---|---|
| Z19053 | 1526 | 2.4 × 10$^{-10}$ |
| Z19054 | 1528 | 2.5 × 10$^{-10}$ |
| Z19056 | 1586 | 2.2 × 10$^{-10}$ |
| Z19057 | 1558 | 2.2 × 10$^{-10}$ |
| Z19059 | 1240 | 3.5 × 10$^{-10}$ |
| Z19060 | 1228 | 2.2 × 10$^{-10}$ |
| Z19072 | 1554 | 1.6 × 10$^{-10}$ |
| Z19075 | 1618 | 1.5 × 10$^{-10}$ |
| Z19078 | 1248 | 2.2 × 10$^{-10}$ |
| Z19085 | 1564 | 2.1 × 10$^{-10}$ |
| Z19090 | 1540 | 2.0 × 10$^{-10}$ |
| Z19115 | 1489 | 2.3 × 10$^{-10}$ |
| Z19117 | 1631 | 2.1 × 10$^{-10}$ |
| Z19118 | 1579 | 2.3 × 10$^{-10}$ |
| Z19123 | 1241 | 2.6 × 10$^{-10}$ |
| Z19151 | 1594 | 2.3 × 10$^{-10}$ |
| Z19158 | 1571 | 1.5 × 10$^{-10}$ |
| Z19159 | 1364 | 2.1 × 10$^{-10}$ |
| Z19171 | 1593 | 2.3 × 10$^{-10}$ |
| Z19172 | 1551 | 1.6 × 10$^{-10}$ |
| Z19180 | 1393 | 2.0 × 10$^{-10}$ |
| Z19181 | 1549 | 1.8 × 10$^{-10}$ |
| Z19182 | 1628 | 1.7 × 10$^{-10}$ |
| Z19183 | 1235 | 2.2 × 10$^{-10}$ |
| Z19302 | 1419 | 2.6 × 10$^{-10}$ |
| Z19304 | 1273 | 2.7 × 10$^{-10}$ |
| Z19305 | 1261 | 2.6 × 10$^{-10}$ |

Biacore Screening of Z Variants:

A subset of 188 IL-1R-I binding Z variants was submitted to a Biacore kinetic screening. A single concentration of hIL-1R-I was injected over each Z-ABD captured from periplasmic extracts on a sensor chip surface containing an anti-ABD antibody. The calculated screening affinities are presented in Table 18. The K$_D$ values of Z12967, Z16065 and Z16218 were 2.7×10$^{-8}$, 7.5×10$^{-9}$ and 1.3×10$^{-8}$ M (average of duplicates), respectively.

Z18814, which has an amino acid sequence that only differs from Z16065 in position X$_5$ of the binding motif BM, has three times higher affinity than Z-6065. Z16065 has the highest binding affinity (K$_D$) among the IL-1R-I binding Z variants (Table 11) with an alanine residue in position X$_5$. Z18814 has an isoleucine residue in position X$_5$. Several Z variants with valine or isoleucine in position X$_5$ were found to have high affinity to IL-1R-1.

TABLE 18

Calculated KD values from Biacore kinetic screening.

| Z variant | SEQ ID NO | Biacore screening K$_D$ (M) |
|---|---|---|
| Z15840 | 49 | 6.9 × 10$^{-9}$ |
| Z15862 | 71 | 1.3 × 10$^{-8}$ |
| Z15876 | 1206 | 5.7 × 10$^{-9}$ |
| Z15932 | 1207 | 5.5 × 10$^{-9}$ |
| Z15934 | 1208 | 9.4 × 10$^{-9}$ |
| Z15945 | 150 | 9.6 × 10$^{-9}$ |
| Z15975 | 1209 | 8.9 × 10$^{-9}$ |
| Z16062 | 266 | 6.4 × 10$^{-9}$ |
| Z16183 | 379 | 6.5 × 10$^{-9}$ |
| Z16191 | 387 | 6.3 × 10$^{-9}$ |
| Z16208 | 404 | 1.1 × 10$^{-8}$ |
| Z16397 | 582 | 1.3 × 10$^{-8}$ |
| Z16440 | 624 | 1.3 × 10$^{-8}$ |
| Z16603 | 782 | 9.1 × 10$^{-9}$ |
| Z16606 | 785 | 9.6 × 10$^{-9}$ |

TABLE 18-continued

Calculated KD values from Biacore kinetic screening.

| Z variant | SEQ ID NO | Biacore screening K$_D$ (M) |
|---|---|---|
| Z16737 | 910 | 1.2 × 10$^{-8}$ |
| Z18754 | 1252 | 2.5 × 10$^{-9}$ |
| Z18756 | 1366 | 2.9 × 10$^{-9}$ |
| Z18757 | 1321 | 3.0 × 10$^{-9}$ |
| Z18758 | 1281 | 4.8 × 10$^{-9}$ |
| Z18759 | 1314 | 3.4 × 10$^{-9}$ |
| Z18760 | 1435 | 3.0 × 10$^{-9}$ |
| Z18762 | 1415 | 2.1 × 10$^{-9}$ |
| Z18763 | 1431 | 5.2 × 10$^{-9}$ |
| Z18766 | 1274 | 3.1 × 10$^{-9}$ |
| Z18767 | 12353 | 5.1 × 10$^{-9}$ |
| Z18769 | 1339 | 2.7 × 10$^{-9}$ |
| Z18770 | 1284 | 2.6 × 10$^{-9}$ |
| Z18771 | 1341 | 3.0 × 10$^{-9}$ |
| Z18774 | 1389 | 3.0 × 10$^{-9}$ |
| Z18776 | 1418 | 2.8 × 10$^{-9}$ |
| Z18777 | 1326 | 3.8 × 10$^{-9}$ |
| Z18782 | 1333 | 2.7 × 10$^{-9}$ |
| Z18783 | 1257 | 3.4 × 10$^{-9}$ |
| Z18784 | 1433 | 3.7 × 10$^{-9}$ |
| Z18785 | 1323 | 2.7 × 10$^{-9}$ |
| Z18786 | 1320 | 4.8 × 10$^{-9}$ |
| Z18790 | 1439 | 3.0 × 10$^{-9}$ |
| Z18794 | 1424 | 3.7 × 10$^{-9}$ |
| Z18796 | 1352 | 3.6 × 10$^{-9}$ |
| Z18798 | 1268 | 3.2 × 10$^{-9}$ |
| Z18799 | 1423 | 2.6 × 10$^{-9}$ |
| Z18800 | 1328 | 1.9 × 10$^{-9}$ |
| Z18803 | 1327 | 3.1 × 10$^{-9}$ |
| Z18804 | 1329 | 3.3 × 10$^{-9}$ |
| Z18805 | 1437 | 3.7 × 10$^{-9}$ |
| Z18806 | 1271 | 4.1 × 10$^{-9}$ |
| Z18807 | 1400 | 3.8 × 10$^{-9}$ |
| Z18808 | 1342 | 4.2 × 10$^{-9}$ |
| Z18810 | 1278 | 3.1 × 10$^{-9}$ |
| Z18811 | 1405 | 4.5 × 10$^{-9}$ |
| Z18813 | 1375 | 2.0 × 10$^{-9}$ |
| Z18814 | 1368 | 2.4 × 10$^{-9}$ |
| Z18817 | 1343 | 3.5 × 10$^{-9}$ |
| Z18819 | 1276 | 3.0 × 10$^{-9}$ |
| Z18820 | 1417 | 3.3 × 10$^{-9}$ |
| Z18821 | 1269 | 3.5 × 10$^{-9}$ |
| Z18823 | 1282 | 2.4 × 10$^{-9}$ |
| Z18824 | 1264 | 3.3 × 10$^{-9}$ |
| Z18825 | 1275 | 4.9 × 10$^{-9}$ |
| Z18826 | 1356 | 3.5 × 10$^{-9}$ |
| Z18827 | 1318 | 4.3 × 10$^{-9}$ |
| Z18828 | 1296 | 2.6 × 10$^{-9}$ |
| Z18830 | 1295 | 2.9 × 10$^{-9}$ |
| Z18831 | 1308 | 3.0 × 10$^{-9}$ |
| Z18832 | 1340 | 1.6 × 10$^{-9}$ |
| Z18833 | 1297 | 3.8 × 10$^{-9}$ |
| Z18834 | 1361 | 2.4 × 10$^{-9}$ |
| Z18836 | 1430 | 2.9 × 10$^{-9}$ |
| Z18838 | 1337 | 3.3 × 10$^{-9}$ |
| Z18839 | 1440 | 3.1 × 10$^{-9}$ |
| Z18841 | 1359 | 2.5 × 10$^{-9}$ |
| Z18843 | 1309 | 3.1 × 10$^{-9}$ |
| Z18844 | 1349 | 4.0 × 10$^{-9}$ |
| Z18846 | 1331 | 2.1 × 10$^{-9}$ |
| Z18847 | 1363 | 3.0 × 10$^{-9}$ |
| Z18848 | 1304 | 3.0 × 10$^{-9}$ |
| Z18849 | 1299 | 3.0 × 10$^{-9}$ |
| Z18850 | 1367 | 2.6 × 10$^{-9}$ |
| Z18851 | 1291 | 3.6 × 10$^{-9}$ |
| Z18853 | 1298 | 2.3 × 10$^{-9}$ |
| Z18856 | 1330 | 2.9 × 10$^{-9}$ |
| Z18860 | 1265 | 6.2 × 10$^{-9}$ |
| Z18861 | 1369 | 3.3 × 10$^{-9}$ |
| Z18863 | 1362 | 2.4 × 10$^{-9}$ |
| Z18866 | 1324 | 2.7 × 10$^{-9}$ |
| Z18868 | 1391 | 2.7 × 10$^{-9}$ |
| Z18870 | 1428 | 3.0 × 10$^{-9}$ |
| Z18871 | 1332 | 3.5 × 10$^{-9}$ |

TABLE 18-continued

Calculated KD values from Biacore kinetic screening.

| Z variant | SEQ ID NO | Biacore screening $K_D$ (M) |
|---|---|---|
| Z18872 | 1410 | $2.6 \times 10^{-9}$ |
| Z18873 | 1306 | $3.1 \times 10^{-9}$ |
| Z18874 | 1421 | $2.3 \times 10^{-9}$ |
| Z18875 | 1420 | $2.7 \times 10^{-9}$ |
| Z18876 | 1286 | $3.7 \times 10^{-9}$ |
| Z18877 | 1301 | $2.7 \times 10^{-9}$ |
| Z18878 | 1302 | $3.8 \times 10^{-9}$ |
| Z18879 | 1390 | $6.2 \times 10^{-9}$ |
| Z18881 | 1355 | $3.2 \times 10^{-9}$ |
| Z18882 | 1311 | $2.6 \times 10^{-9}$ |
| Z18884 | 1403 | $2.7 \times 10^{-9}$ |
| Z18885 | 1294 | $3.9 \times 10^{-9}$ |
| Z18886 | 1432 | $3.9 \times 10^{-9}$ |
| Z18887 | 1386 | $2.9 \times 10^{-9}$ |
| Z18888 | 1422 | $2.6 \times 10^{-9}$ |
| Z18889 | 1344 | $3.4 \times 10^{-9}$ |
| Z18890 | 1352 | $3.1 \times 10^{-9}$ |
| Z18893 | 1353 | $2.1 \times 10^{-9}$ |
| Z18894 | 1312 | $2.5 \times 10^{-9}$ |
| Z18895 | 1411 | $2.6 \times 10^{-9}$ |
| Z18896 | 1436 | $3.5 \times 10^{-9}$ |
| Z18898 | 1285 | $2.5 \times 10^{-9}$ |
| Z18904 | 1587 | $3.4 \times 10^{-9}$ |
| Z18908 | 1591 | $3.6 \times 10^{-9}$ |
| Z18909 | 1303 | $2.7 \times 10^{-9}$ |
| Z18910 | 1416 | $3.1 \times 10^{-9}$ |
| Z18911 | 1441 | $2.8 \times 10^{-9}$ |
| Z18912 | 1251 | $3.6 \times 10^{-9}$ |
| Z18916 | 1536 | $4.1 \times 10^{-9}$ |
| Z18917 | 1509 | $7.1 \times 10^{-9}$ |
| Z18919 | 1350 | $2.8 \times 10^{-9}$ |
| Z18920 | 1270 | $3.2 \times 10^{-9}$ |
| Z18922 | 1533 | $4.9 \times 10^{-9}$ |
| Z18923 | 1482 | $9.0 \times 10^{-9}$ |
| Z18925 | 1479 | $1.1 \times 10^{-8}$ |
| Z18927 | 1372 | $3.4 \times 10^{-9}$ |
| Z18938 | 1370 | $4.5 \times 10^{-9}$ |
| Z18941 | 1409 | $3.3 \times 10^{-9}$ |
| Z18942 | 1483 | $1.5 \times 10^{-8}$ |
| Z18948 | 1414 | $4.3 \times 10^{-9}$ |
| Z18952 | 1290 | $3.0 \times 10^{-9}$ |
| Z18956 | 1625 | $1.4 \times 10^{-8}$ |
| Z18958 | 1283 | $2.8 \times 10^{-9}$ |
| Z18959 | 1357 | $2.9 \times 10^{-9}$ |
| Z18966 | 1272 | $2.9 \times 10^{-9}$ |
| Z18967 | 1388 | $3.2 \times 10^{-9}$ |
| Z18968 | 1472 | $2.4 \times 10^{-9}$ |
| Z18971 | 1559 | $5.5 \times 10^{-9}$ |
| Z18982 | 1553 | $5.2 \times 10^{-9}$ |
| Z18989 | 1592 | $4.5 \times 10^{-9}$ |
| Z19012 | 1588 | $4.5 \times 10^{-9}$ |
| Z19031 | 1600 | $3.1 \times 10^{-9}$ |
| Z19043 | 1505 | $3.4 \times 10^{-9}$ |
| Z19053 | 1526 | $8.7 \times 10^{-9}$ |
| Z19054 | 1528 | $7.0 \times 10^{-9}$ |
| Z19056 | 1586 | $6.9 \times 10^{-9}$ |
| Z19057 | 1558 | $4.2 \times 10^{-9}$ |
| Z19059 | 1240 | $9.2 \times 10^{-9}$ |
| Z19060 | 1228 | $1.0 \times 10^{-8}$ |
| Z19072 | 1554 | $5.2 \times 10^{-9}$ |
| Z19075 | 1618 | $4.8 \times 10^{-9}$ |
| Z19078 | 1248 | $9.5 \times 10^{-9}$ |
| Z19079 | 1236 | $1.4 \times 10^{-8}$ |
| Z19085 | 1564 | $4.9 \times 10^{-9}$ |
| Z19090 | 1540 | $3.0 \times 10^{-9}$ |
| Z19094 | 1231 | $1.8 \times 10^{-8}$ |
| Z19099 | 1548 | $3.8 \times 10^{-9}$ |
| Z19107 | 1566 | $6.7 \times 10^{-9}$ |
| Z19115 | 1489 | $6.1 \times 10^{-9}$ |
| Z19117 | 1631 | $4.2 \times 10^{-9}$ |
| Z19118 | 1579 | $8.4 \times 10^{-9}$ |
| Z19123 | 1241 | $1.1 \times 10^{-8}$ |
| Z19127 | 1213 | $9.8 \times 10^{-9}$ |
| Z19135 | 1247 | $1.6 \times 10^{-8}$ |
| Z19141 | 1506 | $1.7 \times 10^{-8}$ |
| Z19143 | 1471 | $1.4 \times 10^{-9}$ |
| Z19144 | 1374 | $3.1 \times 10^{-9}$ |
| Z19146 | 1434 | $2.9 \times 10^{-9}$ |
| Z19147 | 1307 | $2.4 \times 10^{-9}$ |
| Z19151 | 1594 | $2.7 \times 10^{-9}$ |
| Z19153 | 1310 | $3.1 \times 10^{-9}$ |
| Z19158 | 1571 | $1.5 \times 10^{-9}$ |
| Z19159 | 1364 | $1.9 \times 10^{-9}$ |
| Z19160 | 1379 | $3.8 \times 10^{-9}$ |
| Z19166 | 1305 | $3.5 \times 10^{-9}$ |
| Z19168 | 1500 | $4.6 \times 10^{-9}$ |
| Z19169 | 1402 | $2.7 \times 10^{-9}$ |
| Z19170 | 1334 | $2.0 \times 10^{-9}$ |
| Z19171 | 1593 | $3.0 \times 10^{-9}$ |
| Z19172 | 1551 | $4.5 \times 10^{-9}$ |
| Z19180 | 1393 | $7.9 \times 10^{-10}$ |
| Z19181 | 1549 | $9.7 \times 10^{-9}$ |
| Z19182 | 1628 | $2.8 \times 10^{-9}$ |
| Z19183 | 1235 | $1.2 \times 10^{-8}$ |
| Z19302 | 1419 | $3.2 \times 10^{-9}$ |
| Z19303 | 1262 | $4.0 \times 10^{-9}$ |
| Z19304 | 1273 | $4.5 \times 10^{-9}$ |
| Z19305 | 1261 | $3.8 \times 10^{-9}$ |

Example 9

Production and Characterization of Z Variants from the First and Second Matured Libraries This Example describes the general procedure for subcloning and production of His$_6$-tagged Z variants originating from the first and second maturation library phage selections, characterization of their target binding, target blocking and melting points.

Materials and Methods

Subcloning of Z Variants with a His$_6$ Tag:

A subset of Z variants screened in Example 8 was chosen for subcloning. The DNA of the respective Z variant was amplified from the phage library vector pAY02592 and was subcloned with an N-terminal His$_6$ tag using standard molecular biology techniques essentially as described in Example 2.

Cultivation:

E. coli T7E2 cells (GeneBridges) were transformed with plasmids containing the gene fragment of each respective IL-1R-I binding Z variant. The resulting recombinant strains were cultivated in media supplemented with 50 µg/ml kanamycin at 30° C. in 50 ml scale using the EnPresso protocol (BioSilta). In order to induce protein expression, IPTG was added to a final concentration of 0.2 mM at $OD_{600} \approx 10$. After induction, the cultivations were incubated for 16 h. The cells were harvested by centrifugation.

Purification of IL-1R-I Binding Z Variants with a His$_6$ Tag:

Approximately ⅔ of the IL-1R-I binding Z variants were purified as described in Example 2 but without the buffer exchange between the IMAC and RPC purification steps. The linear gradient during RPC purification was also changed to 0-60% RPC solvent B for 18 ml. The remaining ⅓ of the IL-1R-I binding Z variants were only IMAC purified before the final buffer exchange to PBS. Purification was essentially performed as described in the first part of Example 2. Approximately 1-2 g of each cell pellet was used.

Biacore Kinetic Analysis:

The kinetic constants ($k_{on}$ and $k_{off}$) and affinities ($K_D$) for human and cynomolgus IL-1R-I were determined for $His_6$-tagged Z variants using a Biacore 2000 instrument (GE Healthcare). The experiment was run essentially as described in Example 5, using 48, 12, 3 and 0.75 nM of the Z variants. The analyte injection time was 3 min followed by 6 min dissociation and 2×5 s glycine pH 3.0, supplemented with 0.5 M NaCl, was used for regeneration of the surfaces between the cycles. Kinetic constants were calculated from the obtained sensorgrams of three or four concentrations of the respective Z variant, using a 1:1 binding model in the BiaEvaluation software 4.1 (GE Healthcare). $His_6$-tagged Z12967 (SEQ ID NO:9), Z16065 (SEQ ID NO:268), Z16163 (SEQ ID NO:359) and Z18557 (SEQ ID NO:1205) were included in the assay for comparison.

In Vitro IL-1β Neutralization Assay:

$His_6$-tagged IL-1R-I specific Z variants were tested for their inhibitory capacity in the TF-1 cell assay. The assay was run as described in Example 2. The data on cell growth was assessed by non-linear regression to a four-parameter dose-response curve, and $IC_{50}$ values were determined using GraphPadPrism program. $His_6$-tagged Z12967, Z16065, Z16163 and Z18557 were included for comparison.

Circular Dichroism (CD) Spectroscopy Analysis:

CD was analyzed for $His_6$-tagged Z variants, as described in Example 2.

Results

Production of $His_6$-Tagged Z Variants:

The IL-1R-I binding Z variants with a $His_6$ tag were expressed as soluble gene products in *E. coli*. The amount of purified protein was determined spectrophotometrically by measuring the absorbance at 280 nm and ranged from approximately 0.4 to 7 mg protein per g pellet for IL-1R-I binding Z variants which were both IMAC and RPC purified. The amount of purified protein ranged from approximately 4 to 15 mg protein per g pellet for IL-1R-I binding Z variants which were only IMAC purified. SDS-PAGE analysis of each final protein preparation showed that these predominantly contained the IL-1R-I binding Z variant. The correct identity and molecular weight of each Z variant were confirmed by HPLC-MS analysis.

Biacore Kinetic Analysis:

The interactions of $His_6$-tagged IL-1R-1-binding Z variants with human and cynomolgus IL-1R-I were analyzed in a Biacore instrument by injecting various concentrations of the Z variants over a surface containing immobilized IL-1R-1. A summary of the calculated kinetic parameters ($K_D$, $k_{on}$ and $k_{off}$) for the human IL-1R-I binding is given in Table 19. The $K_D$ values of Z12967, Z16065, Z16163 and Z18557 were $8.2 \times 10^{-10}$, $5.1 \times 10^{-10}$, $7.6 \times 10^{-10}$ and $1.4 \times 10^{-10}$ M, respectively. The $K_D$ values of cynomolgus IL-1R-1 binding were $2.0 \times 10^{-9}$, $6.7 \times 10^{-9}$ and $3.3 \times 10^{-9}$ M for Z18754, Z18760 and Z18800, respectively.

TABLE 19

Kinetic parameters and affinities for $His_6$-Z polypeptides binding to human IL-1R-I.

| Z variant | SEQ ID NO | $k_{on}$ (1/Ms) | $k_{off}$ (1/s) | $K_D$ (M) |
|---|---|---|---|---|
| Z15876 | 1206 | $5.2 \times 10^6$ | $4.1 \times 10^{-3}$ | $8.0 \times 10^{-10}$ |
| Z15932 | 1207 | $1.8 \times 10^7$ | $1.1 \times 10^{-2}$ | $6.4 \times 10^{-10}$ |

TABLE 19-continued

Kinetic parameters and affinities for $His_6$-Z polypeptides binding to human IL-1R-I.

| Z variant | SEQ ID NO | $k_{on}$ (1/Ms) | $k_{off}$ (1/s) | $K_D$ (M) |
|---|---|---|---|---|
| Z15934 | 1208 | $1.4 \times 10^7$ | $1.1 \times 10^{-2}$ | $7.5 \times 10^{-10}$ |
| Z15975 | 1209 | $4.1 \times 10^7$ | $2.9 \times 10^{-2}$ | $7.1 \times 10^{-10}$ |
| Z18754 | 1252 | $7.0 \times 10^7$ | $6.0 \times 10^{-3}$ | $8.6 \times 10^{-11}$ |
| Z18760 | 1435 | $1.3 \times 10^7$ | $2.7 \times 10^{-3}$ | $2.1 \times 10^{-10}$ |
| Z18762 | 1415 | $4.2 \times 10^7$ | $5.2 \times 10^{-3}$ | $1.3 \times 10^{-10}$ |
| Z18769 | 1339 | $1.9 \times 10^7$ | $3.1 \times 10^{-3}$ | $1.6 \times 10^{-10}$ |
| Z18770 | 1284 | $3.0 \times 10^7$ | $5.0 \times 10^{-3}$ | $1.7 \times 10^{-10}$ |
| Z18799 | 1423 | $2.6 \times 10^7$ | $4.5 \times 10^{-3}$ | $1.8 \times 10^{-10}$ |
| Z18800 | 1328 | $1.8 \times 10^7$ | $2.5 \times 10^{-3}$ | $1.4 \times 10^{-10}$ |
| Z18813 | 1375 | $2.0 \times 10^7$ | $3.9 \times 10^{-3}$ | $2.0 \times 10^{-10}$ |
| Z18814 | 1368 | $3.0 \times 10^7$ | $4.4 \times 10^{-3}$ | $1.5 \times 10^{-10}$ |
| Z18817 | 1343 | $2.8 \times 10^7$ | $4.8 \times 10^{-3}$ | $1.7 \times 10^{-10}$ |
| Z18823 | 1283 | $4.7 \times 10^6$ | $1.8 \times 10^{-3}$ | $3.8 \times 10^{-10}$ |
| Z18831 | 1308 | $4.0 \times 10^7$ | $5.3 \times 10^{-3}$ | $1.3 \times 10^{-10}$ |
| Z18832 | 1340 | $5.9 \times 10^7$ | $7.0 \times 10^{-3}$ | $1.2 \times 10^{-10}$ |
| Z18834 | 1361 | $5.8 \times 10^7$ | $8.0 \times 10^{-3}$ | $1.4 \times 10^{-10}$ |
| Z18846 | 1331 | $4.7 \times 10^7$ | $5.1 \times 10^{-3}$ | $1.1 \times 10^{-10}$ |
| Z18850 | 1367 | $1.3 \times 10^7$ | $2.3 \times 10^{-3}$ | $1.7 \times 10^{-10}$ |
| Z18853 | 1298 | $2.2 \times 10^7$ | $3.0 \times 10^{-3}$ | $1.4 \times 10^{-10}$ |
| Z18856 | 1330 | $4.6 \times 10^7$ | $5.7 \times 10^{-3}$ | $1.2 \times 10^{-10}$ |
| Z18863 | 1362 | $2.2 \times 10^7$ | $4.8 \times 10^{-3}$ | $2.2 \times 10^{-10}$ |
| Z18866 | 1324 | $3.6 \times 10^7$ | $4.2 \times 10^{-3}$ | $1.2 \times 10^{-10}$ |
| Z18874 | 1421 | $4.9 \times 10^7$ | $5.2 \times 10^{-3}$ | $1.1 \times 10^{-10}$ |
| Z18875 | 1420 | $2.4 \times 10^7$ | $2.8 \times 10^{-3}$ | $1.2 \times 10^{-10}$ |
| Z18882 | 1311 | $1.2 \times 10^7$ | $3.0 \times 10^{-3}$ | $2.5 \times 10^{-10}$ |
| Z18888 | 1422 | $1.8 \times 10^7$ | $2.9 \times 10^{-3}$ | $1.6 \times 10^{-10}$ |
| Z18893 | 1353 | $8.6 \times 10^6$ | $2.4 \times 10^{-3}$ | $2.7 \times 10^{-10}$ |
| Z18898 | 1285 | $6.7 \times 10^7$ | $4.4 \times 10^{-3}$ | $6.6 \times 10^{-11}$ |
| Z18912 | 1251 | $9.2 \times 10^7$ | $1.9 \times 10^{-2}$ | $2.1 \times 10^{-10}$ |
| Z18920 | 1270 | $3.6 \times 10^7$ | $5.5 \times 10^{-3}$ | $1.5 \times 10^{-10}$ |
| Z18968 | 1472 | $3.0 \times 10^7$ | $8.4 \times 10^{-3}$ | $2.8 \times 10^{-10}$ |
| Z19072 | 1554 | $4.3 \times 10^7$ | $1.8 \times 10^{-2}$ | $4.1 \times 10^{-10}$ |
| Z19075 | 1618 | $1.4 \times 10^7$ | $6.4 \times 10^{-3}$ | $4.5 \times 10^{-10}$ |
| Z19143 | 1471 | $1.7 \times 10^7$ | $3.9 \times 10^{-3}$ | $2.2 \times 10^{-10}$ |
| Z19147 | 1307 | $2.8 \times 10^7$ | $4.3 \times 10^{-3}$ | $1.5 \times 10^{-10}$ |
| Z19151 | 1594 | $2.8 \times 10^7$ | $7.0 \times 10^{-3}$ | $2.5 \times 10^{-10}$ |
| Z19158 | 1571 | $2.7 \times 10^7$ | $4.4 \times 10^{-3}$ | $1.6 \times 10^{-10}$ |
| Z19159 | 1364 | $2.7 \times 10^7$ | $5.0 \times 10^{-3}$ | $1.9 \times 10^{-10}$ |
| Z19170 | 1334 | $2.1 \times 10^7$ | $4.3 \times 10^{-3}$ | $2.0 \times 10^{-10}$ |
| Z19172 | 1551 | $4.9 \times 10^7$ | $2.3 \times 10^{-2}$ | $4.6 \times 10^{-10}$ |
| Z19180 | 1393 | $2.2 \times 10^7$ | $3.1 \times 10^{-3}$ | $1.4 \times 10^{-10}$ |
| Z19181 | 1549 | $2.0 \times 10^7$ | $1.6 \times 10^{-2}$ | $8.2 \times 10^{-10}$ |
| Z19182 | 1628 | $2.1 \times 10^7$ | $5.5 \times 10^{-3}$ | $2.6 \times 10^{-10}$ |

In vitro IL-1β neutralization assay: The IL-1β inhibition ability of $His_6$-tagged IL-1R-1-binding Z variants was analyzed in a TF-1 cell assay. The resulting $IC_{50}$ values are presented in Table 20. The $IC_{50}$ values of Z12967, Z16065, Z16163 and Z18557 were 7.4, 3.3, 3.3 and 0.6 nM, respectively.

TABLE 20

$IC_{50}$ values for $His_6$-Z polypeptides from a TF-1 cell assay.

| Z variant | SEQ ID NO | $IC_{50}$ (nM) |
|---|---|---|
| Z15934 | 1208 | 6.4 |
| Z15975 | 1209 | 3.3 |
| Z18754 | 1252 | 0.6 |
| Z18760 | 1435 | 0.9 |
| Z18813 | 1375 | 1.2 |
| Z18814 | 1368 | 0.4 |
| Z18831 | 1308 | 0.4 |
| Z18832 | 1340 | 0.5 |
| Z18834 | 1361 | 0.5 |
| Z18846 | 1331 | 0.2 |
| Z18874 | 1421 | 0.3 |
| Z18912 | 1251 | 1 |
| Z18968 | 1472 | 1.4 |
| Z19072 | 1554 | 2.4 |
| Z19159 | 1364 | 1.2 |

TABLE 20-continued

IC$_{50}$ values for His$_6$-Z polypeptides from a TF-1 cell assay.

| Z variant | SEQ ID NO | IC$_{50}$ (nM) |
|---|---|---|
| Z19172 | 1551 | 2 |
| Z19181 | 1549 | 4.6 |
| Z19182 | 1628 | 1.5 |

Cd Analysis:

The CD spectra determined for the IL-1R-I binding Z variants with a His$_6$ tag showed that each had an α-helical structure at 20° C. This result was also verified in the variable temperature measurements, wherein melting temperatures were determined (Table 21). Reversible folding was seen for all the IL-1R-I binding Z variants when overlaying spectra measured before and after heating to 90° C.

The thermo-stability and the α-helical content of the IL-1R-I binding Z variants having a valine or isoleucine residue in position X$_5$ of the BM (Z18912, Z18920, Z18968, Z19072, Z19075, Z19143, Z19147, Z19151, Z19158, Z19159, Z19170, Z19172, Z19180, Z19181 and Z19182) were not substantially different from the Z variants having an alanine residue in position X$_5$.

TABLE 21

Melting temperatures (Tm).

| Z variant | SEQ ID NO | Tm (° C.) |
|---|---|---|
| Z15876 | 1206 | 55 |
| Z15932 | 1207 | 60 |
| Z15934 | 1208 | 62 |
| Z15975 | 1209 | 59 |
| Z18754 | 1252 | 63 |
| Z18760 | 435 | 57 |
| Z18762 | 1415 | 62 |
| Z18769 | 1339 | 59 |
| Z18770 | 1284 | 59 |
| Z18799 | 1423 | 60 |
| Z18800 | 1328 | 67 |
| Z18813 | 1375 | 61 |
| Z18814 | 1368 | 61 |
| Z18817 | 1343 | 60 |
| Z18823 | 1283 | 52 |
| Z18831 | 1308 | 58 |
| Z18832 | 1340 | 58 |
| Z18834 | 1361 | 58 |
| Z18846 | 1331 | 60 |
| Z18850 | 1367 | 62 |
| Z18853 | 1298 | 59 |
| Z18856 | 1330 | 61 |
| Z18863 | 1362 | 57 |
| Z18866 | 1324 | 61 |
| Z18874 | 1421 | 61 |
| Z18875 | 1420 | 61 |
| Z18882 | 1311 | 53 |
| Z18888 | 1422 | 61 |
| Z18893 | 1353 | 60 |
| Z18898 | 1285 | 59 |
| Z18912 | 1251 | 53 |
| Z18920 | 1270 | 56 |
| Z18968 | 1472 | 62 |
| Z19072 | 1554 | 63 |
| Z19075 | 1618 | 56 |
| Z19143 | 1471 | 56 |
| Z19147 | 1307 | 57 |
| Z19151 | 1594 | 59 |
| Z19158 | 1571 | 55 |
| Z19159 | 1364 | 54 |
| Z19170 | 1334 | 52 |
| Z19172 | 1551 | 59 |
| Z19180 | 1393 | 58 |
| Z19181 | 1549 | 61 |
| Z19182 | 1628 | 62 |

Example 10

Production and Characterization of IL-1R-I Binding Fusion Proteins

This Example describes the common steps for DNA construction and production of different IL-1R-I binding proteins variants fused to different in vivo half-life extending fusion partners.

Materials and Methods

DNA Construction:

DNA encoding a set of IL-1R-I binding Z variants (see below) fused to human IgG1 Fc (SEQ ID NO:1662), an albumin binding polypeptide variant (PP013; SEQ ID NO:1661), human albumin (SEQ ID NO:1663) or human transferrin (SEQ ID NO:1664), optionally via different linkers (Table 22), were codon optimized for expression in *E. coli* or for expression in Chinese hamster ovary (CHO) cells and synthesized by the Invitrogen GeneArt Gene Synthesis service at Thermo Fisher Scientific. The genes were cloned in expression vectors for subsequent expression in *E. coli* or in CHO cells.

The fusion proteins were based on the binding motifs of the IL-1R-I binding Z variants a) Z12967 (SEQ ID NO:9), b) Z12895 (SEQ ID NO:12), c) Z18831 (SEQ ID NO:1308), d) Z18846 (SEQ ID NO:1331), e) Z18754 (SEQ ID NO:1252), f) Z19151(SEQ ID NO:1594), g) Z18874 (SEQ ID NO:1421), h) Z18760 (SEQ ID NO:1435), i) Z18800 (SEQ ID NO:1328), j) Z18898 (SEQ ID NO:1285) and k) Z19147 (SEQ ID NO:1307) and the different fusions partners described above. The IL-1R-I binding Z variants a)-k) contained different scaffold mutations, (positions 1, 2, 23, 52 and/or 53) or a deletion combined with mutations (deletion at positions 1-3; AV1 D2A3, mutations in positions 52 and 53), see Table 22 below. The mutated Z variants are listed in FIG. 1 as SEQ ID NO:1667-1668 and 1670-1679. These obtained fusion polypeptides were PS10405 (SEQ ID NO:1639), PS10407 (SEQ ID NO:1640), PS10411 (SEQ ID NO:1641), PS10412 (SEQ ID NO:1642), PS10415 (SEQ ID NO:1643), PS10416 (SEQ ID NO:1644), PS10417 (SEQ ID NO:1645), PS10534 (SEQ ID NO:1646), PS10535 (SEQ ID NO:1647), PS10536 (SEQ ID NO:1648), PS10537 (SEQ ID NO:1649), PS10538 (SEQ ID NO:1650), PS10539 (SEQ ID NO:1651), PS10574 (SEQ ID NO:1652), PS10575 (SEQ ID NO:1653), PS10576 (SEQ ID NO:1654), PS10580 (SEQ ID NO:1655), PS10581 (SEQ ID NO:1656), PS10582 (SEQ ID NO:1657), see Table 22.

TABLE 22

Fusion proteins and expression systems

| SEQ ID NO | Fusion proteins | Construct | Expression system |
|---|---|---|---|
| 1639 | PSI0405 | Z12967[V1A; D2E; N52S; D53E]-VEGS-ABD | E. coli |
| 1640 | PSI0407 | Z12895[V1A; D2E; N52S; D53E]-VEGS-ABD | E. coli |
| 1641 | PSI0411 | AS-ABD-GS-Z12967[V1A; D2E; N52S; D53E] | E. coli |
| 1642 | PSI0412 | AS-ABD-($G_4S$)$_2$-Z12967[V1A; D2E; N52S; D53E] | E. coli |
| 1643 | PSI0415 | AS-ABD-Z12967[V1A; D2E; N52S; D53E] | E. coli |
| 1644 | PSI0416 | AS-ABD-Z12967[ΔV1D2A3; N52S; D53E] | E. coli |
| 1645 | PSI0417 | AS-ABD-((KEAAA)$_3$KELAA)$_2$-Z12967[V1A; D2E; N52S; D53E] | E. coli |
| 1646 | PSI0534 | Z18831[V1A; D2E; N52S; D53E]-AS($G_4S$)$_2$-IgG1 Fc | E. coli |
| 1647 | PSI0535 | Z18846[V1A; D2E; N52S; D53E]-AS($G_4S$)$_2$-IgG1 Fc | E. coli |
| 1648 | PSI0536 | Z18754[V1A; D2E; N52S; D53E]-AS($G_4S$)$_2$-IgG1 Fc | E. coli |
| 1649 | PSI0537 | Z19151[V1A; D2E; N52S; D53E]-AS($G_4S$)$_2$-IgG1 Fc | E. coli |
| 1650 | PSI0538 | Z18874[V1A; D2E; N52S; D53E]-AS($G_4S$)$_2$-IgG1 Fc | E. coli |
| 1651 | PSI0539 | Z18760[V1A; D2E; N52S; D53E]-AS($G_4S$)$_2$-IgG1 Fc | E. coli |
| 1652 | PSI0574 | Z18800[V1A; D2E; N52S; D53E]-AS($G_4S$)$_2$-IgG1 Fc | E. coli |
| 1653 | PSI0575 | Z18898[V1A; D2E; N52S; D53E]-AS($G_4S$)$_2$-IgG1 Fc | E. coli |
| 1654 | PSI0576 | Z19147[V1A; D2E; N52S; D53E]-AS($G_4S$)$_2$-IgG1 Fc | E. coli |
| 1655 | PSI0580 | Z18754[V1A; D2E; N52S; D53E]-AS($G_4S$)$_2$-Albumin | CHO |
| 1656 | PSI0581 | Z18754[V1A; D2E; T23N; N52S; D53E]-AS($G_4S$)$_2$-Albumin | CHO |
| 1657 | PSI0582 | Z18754[V1A; D2E; N52S; D53E]-AS($G_4S$)$_2$-Transferrin | CHO |
| 1658 | PSI0589 | PSI0536[amino acids 1-86], dimeric | |

Cultivation and Purification of Fusion Proteins:

E. coli cells were transformed with expression vectors containing the gene fragments corresponding to the IL-1R-I binding fusion proteins, see Table 22, and then cultivated in bioreactors using fed-batch techniques or in shake flasks, followed by protein expression and harvest of cells by centrifugation. Cell pellets were stored at −20° C. Expression of IL-1R-I binding Z variants, see Table 22, were also performed using the ExpiCHO expression system (Thermo Fisher Scientific), essentially according to the manufacturer's protocol. Supernatants were harvested by centrifugation 12 days after transfection of expression vectors and stored at −70° C.

Frozen *E. coli* cell pellets were resuspended and then disrupted by sonication and the cell debris subsequently removed by centrifugation followed by filtration (0.22 μm). The frozen supernatants from the ExpiCHO cultures were thawed and filtrated (0.22 μm). Each supernatant, containing the IL-1R-I binding Z variants was purified using conventional chromatography methods, such as affinity chromatography, ion exchange chromatography, hydrophobic interaction chromatography and size exclusion chromatography. Z variants for use in animal studies were also subjected to an endotoxin removal purification using Detoxi-Gel Endotoxin Removing Columns (Pierce, cat.no. 20344). Purified Z variants were buffer exchanged to PBS and, unless otherwise stated, PBS was also the formulation buffer used in subsequent experiments. The purity of the IL-1R-I binding Z variants was analyzed by SDS-PAGE stained with Coomassie Blue and the molecular weight of each purified Z variant was analyzed using mass spectrometry (HPLC/MS or MALDI-TOF/MS).

The IL-1R-I binding fusion protein PS10589 (SEQ ID NO:1658), a dimeric Z18754 variant linked in the hinge region by disulfides, was obtained by removing the IgG1 Fc part from PS10536, see Table 22. This was achieved by incubation of purified PS10536 with the IdeS protease (FabRICATOR, Genovis AB). The cleavage products were then purified using conventional chromatography methods such as ion exchange chromatography and affinity chromatography. The purified dimeric Z18754 variant was subjected to buffer exchange into PBS, which was also the formulation buffer used in subsequent experiments. The purity was analyzed by SDS-PAGE stained with Coomassie Blue and the molecular weight was analyzed using mass spectrometry (HPLC/MS or MALDI-TOF/MS).

Biolayer Interferometry (BLI) Kinetic Analysis:

Binding of four IL-1R-I binding fusion proteins to human and cynomolgus IL-1R-I was analyzed using BLI. The Fc fused IL-1R-I binding Z variants denoted PS10536, PS10537, PS10534 and PS10535 (SEQ ID NO:1648, 1649, 1646, 1647) were loaded onto a Protein A sensor (Pall, ForteBio cat. no. 18-5010) at 0.5 μg/ml for 150 s in each cycle using an OctetRED96 instrument (Pall, ForteBio). Subsequently, these sensors were exposed to different and increasing concentrations of human IL-1R-I (R&D systems cat. no. 269-1R/CF) ranging from 0.15 to 5 nM or cynomolgus IL-1R-I (SEQ ID NO:1665) ranging from 2.5 to 80 nM. Association was recorded for 300 s and dissociation for 300 s (human) or 90 s (cynomolgus) and spectrograms were recorded and analyzed according to a 1:1 Langmuir model using global fit (Octet System Data Analysis 8.2 software, Pall, ForteBio). Each sensor was referenced to a sensor with the same ligand loaded onto it but exposed to buffer only. Following each association/dissociation cycle, all sensors were regenerated by three pulses of 10 mM glycine at pH 2.5 for 10 s each. All steps were carried out at 25° C. at a shaking speed of 1000 rpm and all dilutions of fusion proteins (Z-Fc fusion proteins) and analytes (human or cynomolgus IL-1R-1) were in 1×kinetics buffer (Pall, ForteBio).

Results

Cultivation and Purification:

All the IL-1R-I binding fusion proteins (Table 22) were expressed to high levels in *E. coli* or CHO cells as soluble proteins. Purification resulted in protein preparations with high purity, which was analyzed by SDS-PAGE stained with Coomassie Blue. The correct identity and molecular weight of each Z variant were confirmed by mass spectrometry analysis.

BLI Kinetic Analysis:

Four Z-Fc fusion protein variants (SEQ ID NO: 1648, 1649, 1646, 1647) were analyzed for the ability to bind human and cynomolgus IL-1R-I loaded onto protein A sensor using BLI technology on an OctetRED96 instrument. All four variants bound IL-1R-I according to a 1:1 model with B-max values ranging from 0.46 to 0.72 nm (human) or 0.31 to 0.37 nm (cynomolgus). The kinetic data; association rate constant ($k_{on}$), dissociation rate constant ($k_{off}$) and dissociation constant $K_D$ for the Z-Fc fusion protein variants are presented in Table 23.

analyzed using XLfit and $IC_{50}$ values were calculated from concentration-response curves.

The inhibitory effect of $His_6$-tagged IL-1R-I binding Z variants, produced as described in Example 9, on IL-1β induced IL-6 production in NHDF cells was similarly monitored and $IC_{50}$ values calculated.

Chemically Synthesized Protein:

A chemically synthesized version of SEQ ID NO:1672, denoted PS10558, was ordered from BACHEM AG. The activity of PS10558 was assessed according to the method set out above.

Results

The IL-1β induced IL-6 release from NHDF cells was reduced in a concentration-dependent manner by the IL-1R-I binding fusion proteins as well as by anakinra. Each IL-1R-I binding fusion protein was tested twice and the data from both experiments along with historical average of anakinra (n>20) in this assay are presented in Table 24 and one of the two experiments is also presented in FIG. 2.

TABLE 24

| | In vitro $IC_{50}$ values | |
|---|---|---|
| Denotation | SEQ ID NO | $IC_{50}$ (pM) |
| PSI0536 | 1648 | 66; 45 |
| PSI0537 | 1649 | 260; 200 |

TABLE 23

Kinetic parameters for IL-1R-I binding fusion proteins

| Fusion proteins and | Human IL-1R-I | | | Cynomolgus IL-1R-I | | |
|---|---|---|---|---|---|---|
| SEQ ID NO | $K_D$ (M) | $k_{on}$ (1/Ms) | $k_{off}$ (1/s) | $K_D$ (M) | $k_{on}$ (1/Ms) | $k_{off}$ (1/s) |
| PSI0536 (SEQ ID NO: 1648) | $7.5 \times 10^{-10}$ | $8.99 \times 10^5$ | $6.79 \times 10^{-4}$ | $1.4 \times 10^{-8}$ | $1.70 \times 10^6$ | $2.34 \times 10^{-2}$ |
| PSI0537 (SEQ ID NO: 1649) | $1.2 \times 10^{-9}$ | $8.41 \times 10^5$ | $1.02 \times 10^{-3}$ | $3.1 \times 10^{-8}$ | $1.78 \times 10^6$ | $5.48 \times 10^{-2}$ |
| PSI0534 (SEQ ID NO: 1646) | $1.6 \times 10^{-9}$ | $4.04 \times 10^5$ | $6.42 \times 10^{-4}$ | $2.8 \times 10^{-8}$ | $1.08 \times 10^6$ | $2.99 \times 10^{-2}$ |
| PSI0535 (SEQ ID NO: 1647) | $7.2 \times 10^{-10}$ | $5.83 \times 10^5$ | $4.21 \times 10^{-4}$ | $1.1 \times 10^{-8}$ | $1.49 \times 10^6$ | $1.66 \times 10^{-2}$ |

Example 11

In Vitro Pharmacological Activity Analysis Using a Cell-Based Assay

Materials and Methods

The inhibitory effect of IL-1R-I binding fusion proteins on IL-1β induced IL-6 production in Normal Human Dermal Fibroblasts (NHDF) cells was monitored.

Cells were seeded three days prior to treatment with proteins. Proteins (IL-1R-I binding fusion proteins or anakinra) were diluted to a starting concentration of 100 nM and subsequently serially 1:4 nine times resulting in a concentration range of 100 nM to 0.38 μM in serum-free growth medium in the presence of 9 μM recombinant human serum albumin (rHSA). The IL-1R-I binding fusion proteins or anakinra were tested in presence of a challenge dose of 3.4 pM IL-1β and the cells were incubated for 22 hours with proteins at 37° C., followed by harvesting of medium. Harvested medium was diluted 41× before IL-6 content was analyzed using a human IL-6 ELISA kit (R&D Systems) according to manufacturer's recommendations. Data was TABLE 24-continued

| | In vitro $IC_{50}$ values | |
|---|---|---|
| Denotation | SEQ ID NO | $IC_{50}$ (pM) |
| PSI0534 | 1646 | 140; 110 |
| PSI0535 | 1647 | 80; 50 |
| PSI0538 | 1650 | 87; 70 |
| PSI0539 | 1651 | 240; 110 |
| anakinra | | Average 70 |

Some IL-1R-I binding fusion proteins were tested in the same manner but only one time. The results from this experiment are presented in Table 25.

TABLE 25

| | In vitro $IC_{50}$ values | |
|---|---|---|
| Denotation | SEQ ID NO | $IC_{50}$ (pM) |
| PSI0589 | 1658 | 1.8 |
| PSI0582 | 1657 | 2.0 |

TABLE 25-continued

| | In vitro IC$_{50}$ values | |
|---|---|---|
| Denotation | SEQ ID NO | IC$_{50}$ (pM) |
| PSI0580 | 1655 | 1500 |
| PSI0581 | 1656 | 1800 |

The IL-1β inhibition ability of His$_6$-tagged IL-1R-I-binding Z variants, previously demonstrated in a TF-1 cell assay (Example 9, Table 20), was confirmed in this NHDF assay (results not shown).

The IC$_{50}$ value of the chemically synthesized PS10558 was 690 µM.

Example 12

In Vitro Pharmacological Activity Analysis Using a Whole Blood Assay

The inhibitory effect of IL-1R-I binding fusion proteins on IL-1β induced IL-6 production in whole blood from individual donors was measured.

Materials and Methods

Blood from healthy donors was collected 1-3 hours prior to treatment with the IL-1R-I binding fusion proteins (SEQ ID NO:1648-1649). Proteins (IL-1R-I binding fusion proteins or anakinra) were diluted to starting concentration of 500 nM in serum free RPMI (ThermoFisher Scientific, RPMI 1640 Medium, GlutaMAX™ Supplement, Cat. No.: 61870010) and subsequently serially diluted 1:3 in a ten-step dilution series resulting in a concentration range of 500 nM to 25 pM. The IL-1R-I binding fusion polypetides or anakinra were tested in presence of a challenge dose of 100 pM IL-1β. The blood was incubated for 21-23 hours with proteins, followed by harvesting of plasma. Harvested plasma was diluted 2× and IL-6 content was analyzed by using a human IL-6 kit (V-PLEX Human IL-6 Kit Human interleukin-6, MSD) according to manufacturer's recommendations.

IL-6 concentrations (pg/ml) were calculated using a standard curve (provided by the kit) and data was analyzed using XLfit and IC$_{50}$ values were calculated from the concentration-response curves.

Results

Figure 3:
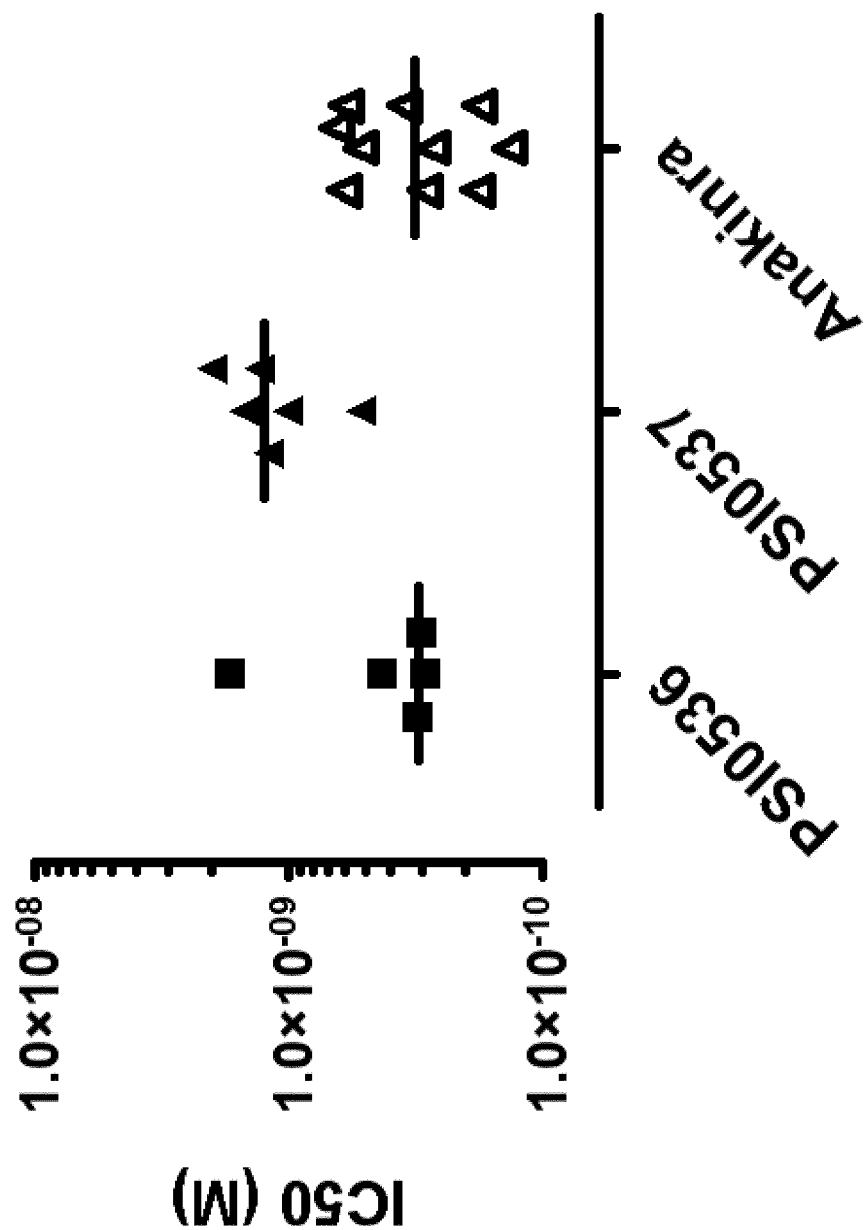

The IL-1β induced IL-6 release in human whole blood was reduced in a concentration-dependent manner by the IL-1R-I binding fusion proteins as well as by anakinra. IL-1R-I binding fusion proteins were tested in blood from five to six individual healthy donors and compared to anakinra data from ten individual blood donors (FIG. 3). The median IC$_{50}$ values were 0.32, 1.25 and 0.31 nM for SEQ ID NO:1648 (PSI0536), SEQ ID NO:1649 (PSI0537) and anakinra, respectively.

Example 13

In Vivo Pharmacokinetics of IL-IR-1 Binding Fusion Proteins in Rats

In this Example, the pharmacokinetics of IL-1R-1-binding fusion proteins (SEQ ID NO:1646-1651) were evaluated in a single dose study in male rats.

Material and Methods

Fusion Proteins:

The IL-1R-I binding fusion proteins PS10534, PS10535, PS10536, PS10537, PS10538 and PS10539 (see Table 22, SEQ ID NO:1646-1651) were evaluated in this study. All six test items were constituted as a solution in 25 mM sodium phosphate and 125 mM sodium chloride, pH 7.0.

In-Life Phase:

The pharmacokinetic properties of the six fusion proteins were investigated in male Sprague-Dawley rats. For each test item, three rats were given an i.v. single dose of 15 mg/kg (2.5 ml/kg) injected in the lateral tail vein and another three rats were given a s.c. single dose of 30 mg/kg (5 ml/kg) injected in the neck region. Blood samples for serum preparation were collected pre dosing and at 5 and 20 min, 1, 4, 8, 24, 48, 72 and 96 hrs post i.v. dosing, or 20 min, 1, 4, 8, 24, 48, 72, 96 and 120 hrs post s.c. dosing.

Quantitative ELISA:

Determination of fusion protein levels in rat serum samples was performed by enzyme-linked immunosorbent assay (ELISA). The ELISA assay employed the quantitative sandwich enzyme immunoassay technique.

In brief; a goat polyclonal anti-Z antibody recognizing the Z variant domain of the IL-1R-I binding fusion protein (produced in house, Affibody AB) was coated onto a microplate. Unbound polyclonal antibody was washed away and casein was added as blocking agent to reduce unspecific binding to the plastic surface. After removal of unbound casein by a second wash step, standards and samples were pipetted to the wells and any fusion protein present was bound to the immobilized antibody. After washing away any unbound substances, a HRP labeled Swine anti-rabbit antibody (Dako, cat. no. P0399) was added. Following a wash to remove any unbound anti-rabbit HRP reagent, a substrate solution was added to the wells and color developed in proportion to the amount of fusion protein bound in the initial step. The color development was stopped and the intensity of the color was measured.

Pharmacokinetic Analysis:

The pharmacokinetic analysis was based on median serum concentration versus time data from each dose group. The observed maximum concentration (C$_{max}$) and the time to maximum serum concentration (t$_{max}$) were taken directly from the bioanalytical data. Other pharmacokinetic parameters, i.e. clearance (CL), apparent clearance following s.c. administration (CL/F), apparent volume of distribution at steady-state (V$_{ss}$), mean residence time (MRT) and terminal half-life (t$_{1/2z}$), were estimated by non-compartmental analysis using Phoenix WinNonlin software version 6.3 (Pharsight Corp., USA). Estimation of the terminal slope following i.v. dosing was based on four data points, from 24 to 96 hrs. Estimation of the terminal slope following s.c. dosing was based on five data points, from 24 to 120 hrs. Calculation of the subcutaneous bioavailability (F) was performed using Microsoft Excel.

Results

There was no significant difference in the pharmacokinetics between the six tested fusion proteins. The pharmacokinetics following i.v. administration was characterized by a clearance in the order of 2.4 ml/h·kg and a volume of distribution of about 140 ml/kg, translating into a mean residence time of ca 60 hrs (Table 26).

TABLE 26

Pharmacokinetic parameter estimates following an intravenous
single dose administration, 15 mg/kg, to male rats

| Parameter | PSI0534 | PSI0535 | PSI0536 | PSI0537 | PSI0538 | PSI0539 |
|---|---|---|---|---|---|---|
| CL (ml/h · kg) | 2.83 | 2.40 | 2.68 | 2.06 | 2.36 | 2.03 |
| $V_{ss}$ (ml/kg) | 159 | 149 | 143 | 136 | 146 | 113 |
| MRT (hrs) | 56.4 | 62.1 | 53.5 | 65.9 | 61.6 | 55.5 |
| $t_{1/2z}$ (hrs) | 48.7 | 52.1 | 44.7 | 55.1 | 50.4 | 48.3 |

The subcutaneous bioavailability was on average 50% and peak levels were observed at 24 hrs after dosing. The serum levels then declined with a half-life ranging from 45 to 59 hrs (Table 27).

TABLE 27

Pharmacokinetic parameter estimates following a subcutaneous
single dose administration, 30 mg/kg, to male rats

| Parameter | PSI0534 | PSI0535 | PSI0536 | PSI0537 | PSI0538 | PSI0539 |
|---|---|---|---|---|---|---|
| F (%) | 41.5 | 49.6 | 46.7 | 60.3 | 47.2 | 52.2 |
| $C_{max}$ (nM) | 828 | 866 | 948 | 1115 | 796 | 886 |
| $t_{max}$ (hrs) | 24 | 24 | 24 | 24 | 24 | 24 |
| CL/F (ml/h · kg) | 6.81 | 5.70 | 6.05 | 4.69 | 5.98 | 5.42 |
| $V_z/F$ (ml/kg) | 445 | 457 | 403 | 372 | 509 | 424 |
| $t_{1/2z}$ (hrs) | 45.3 | 55.6 | 46.1 | 55.1 | 59.0 | 54.3 |
| MRT (hrs) | 72.4 | 87.3 | 74.5 | 87.4 | 91.7 | 86.2 |

Example 14

In Vivo Pharmacokinetics of an IL-1R-I Binding Fusion Protein in Monkeys

Material and Methods

Fusion Proteins:

The IL-1R-I binding fusion protein denoted PS10536 (SEQ ID NO:1648) was constituted as a solution in 25 mM sodium phosphate and 125 mM sodium chloride, pH 7.0.

In-Life Phase:

The pharmacokinetic properties of PS10536 were investigated in naïve male Cynomolgus monkeys. Three monkeys were given an i.v. single dose of 5 mg/kg (1 ml/kg) injected in the tail vein and another three monkeys were given a s.c. single dose of 10 mg/kg (1 ml/kg) injected in the dorsal region. Blood samples for serum preparation were collected pre dosing and at 5 and 20 min, 1, 2, 4, 8, 12, 24, 48, 72, 96, 120, 144, 168, 240 and 504 hrs post i.v. dosing, or 20 min, 1, 2, 4, 8, 12, 24, 48, 72, 96, 120, 144, 168, 240 and 504 hrs post s.c. dosing.

Quantitative ELISA:

Quantification of PS10536 in serum from monkeys was performed according to the ELISA described in Example 13.

Pharmacokinetic Analysis:

Pharmacokinetic parameters were based on individual serum concentration versus time data and determined using WinNonlin software as described in Example 13. Estimation of the terminal slope following i.v. dosing was based on seven data points, from 72 to 504 hrs. Estimation of the terminal slope following s.c. dosing was based on eight data points, from 48 to 504 hrs. Calculation of the subcutaneous bioavailability (F) was performed using Microsoft Excel.

Results

The pharmacokinetics of PS10536 (SEQ ID NO:1648) following i.v. administration was characterized by a low clearance (1.07 ml/h·kg) and a small volume of distribution (117 ml/kg), translating into a mean residence time of 109 hrs (Table 28).

TABLE 28

Mean (±SD) pharmacokinetic parameter estimates of
PSI0536 following an intravenous single dose of 5.04
(±0.01) mg/kg to three male monkeys

| Parameter | Estimate |
|---|---|
| CL (ml/h · kg) | 1.07 ± 0.04 |
| $V_{ss}$ (ml/kg) | 117 ± 3 |
| MRT (hrs) | 109 ± 1 |
| $t_{1/2z}$ (hrs) | 92.7 ± 3.7 |

The mean subcutaneous bioavailability of PS10536 was 73.9%. Peak levels were observed at an average of 18.7 hrs after dosing. The serum levels then declined with a half-life of 77.3 hrs (Table 29).

TABLE 29

Mean (+SD) pharmacokinetic parameter estimates
of PSI0536 following a subcutaneous single dose of
10.1 (+0.1) mg/kg to three male monkeys

| Parameter | Estimate |
|---|---|
| F (%) | 73.9 ± 5.5 |
| $C_{max}$ (nM) | 779 ± 159 |
| $t_{max}$ (hrs) | 18.7 ± 7.5 |
| CL/F (ml/h · kg) | 1.46 ± 0.10 |
| $V_z/F$ (ml/kg) | 163 ± 23 |
| $t_{1/2z}$ (hrs) | 77.3 ± 6.3 |
| MRT (hrs) | 115 ± 14 |

Conclusion

Assuming a minimum target serum concentration of 100 nM or even 200 nM, the high subcutaneous bioavailability in combination with the low clearance facilitates a once weekly subcutaneous dose regimen of 10 mg/kg PS10536 in monkey.

Example 15

Production and Characterization of IL-1-1R-I Binding Fusion Proteins with Mutations in the Fc Portion Four IL-1-R-I binding fusion proteins of the IL-1R-I binding polypeptide variant Z18754 (SEQ ID NO:1252) with mutated variants of the Fc portion of IgG1 or IgG4 were produced. In the IgG1 Fc portion, one mutation [N297A] was introduced in order to abolish effector functions through interaction with FCγR3A. Fc-containing polypeptides produced in mammalian cells might otherwise cause such effector functions. In addition, in one fusion protein (SEQ ID NO:1735) two other residues were introduced, denoted LS (WO2009/086320), to increase affinity to FcRn, and in another fusion protein (SEQ ID NO:1736) three mutations denoted YTE (WO02060919) were introduced to increase affinity to FcRn. One fusion protein of Z18754 (SEQ ID NO:1252) with an IgG4 Fc a subtype, which is known to elicit low effector responses, was produced (SEQ ID NO:1737). One mutation, known as S228P (van der Neut Kolfschoten M. et al., 2007, Science 317 (5844):1554-7), was furthermore introduced in the hinge region of this fusion protein. This mutation abolishes the arm exchange that may take place for the IgG4 subclass of antibodies.

Material and Methods

The fusion proteins PS10653-PS10656 (SEQ ID NO:1734-1737), see Table 30 for specifications, were produced in CHO cells according to Example 10.

The inhibitory effect of IL-1R-I binding fusion proteins on IL-1β induced IL-6 production in Normal Human Dermal Fibroblasts (NHDF) cells was monitored as set out in Example 11.

The affinity towards FCγR3A was analysed with Biolayer Interferometry essentially as disclosed in Example 10, with the exception that biotinylated FCγR3A (Sino Biological) was immobilized on a Streptavidin biosensor for kinetics (Pall/Fortebio) and the proteins were tested using concentrations of 100 and 1000 nM. In addition Human IgG (GammaNorm, Octapharma) was used as control in the measurements.

The affinity towards FcRn was assessed using Biacore essentially as described in Example 9 with the exception that human biotinylated FcRn (Immunitrack ApS) was immobilized on a Biotin CAPture chip (GE Healthcare) and the analytes were tested in five concentrations, ranging from 2.5-200 nM.

TABLE 30

Fusion proteins and expression systems

| SEQ ID NO | Fusion proteins | Construct | Expression system |
|---|---|---|---|
| 1734 | PSI0653 | Z18754[N297A]-IgG1 Fc | CHO |
| 1735 | PSI0654 | Z18754[N297A]-LS-IgG1 Fc | CHO |
| 1736 | PSI0655 | Z18754[N297A]-YTE-IgG1 Fc | CHO |
| 1737 | PSI0656 | Z18754[S228P]-IgG4 Fc | CHO |

Results

Cultivation and Purification:

All the IL-1-R-I binding fusion proteins with mutated Fc portions (Table 30) were expressed at high levels in CHO cells as soluble proteins. Purification resulted in protein preparations with high purity, which were analyzed by SDS-PAGE stained with Coomassie Blue. The correct identity and molecular weight of each Z variant were confirmed by mass spectrometry analysis.

In vitro pharmacological activity: The IL-1β induced IL-6 release from NHDF cells was reduced in a concentration-dependent manner by the IL-1R-1 binding fusion proteins. The IL-1R-1 binding fusion proteins were tested one time. The results from this experiment are accounted for in Table 31.

TABLE 31

| In vitro $IC_{50}$ values | | |
|---|---|---|
| SEQ ID NO: | Fusion proteins | $IC_{50}$ (pM) |
| 1734 | PSI0653 | 4.3 |
| 1735 | PSI0654 | 2.9 |
| 1736 | PSI0655 | 5.9 |
| 1737 | PSI0656 | 8.4 |

FCγR3A Affinity Analysis:

Human IgG bound to FCγR3A with an affinity of 57 nM at 1000 nM concentration. The fusion proteins PS10653-PS10655 (SEQ ID NO 1734-1736) showed no binding at either concentration. PS10656 (SEQ ID NO 1737) showed a weak binding at 1000 nM but no binding at 100 nM.

Biacore FcRn Affinity Analysis:

The affinity towards FcRn were in the order SEQ ID NO 1735>SEQ ID NO 1736>SEQ ID NO 1734=SEQ ID NO 1737.

Conclusion:

The mutated Fc variants of the fusion proteins (SEQ ID NO:1734:1737) were equal to the previously produced proteins in terms of quality and activity (see Example 10). The removal of glycan attachment site removed the effector function of the IgG1 Fc portion in SEQ ID NO:1734-1736 as binding to FCγR3A was abolished. The IgG4 Fc containing SEQ ID NO:1737 had low affinity towards FCγR3A as expected for an Fc of that subclass. The FcRn affinity enhancing mutations in SEQ ID NO:1735 and 1736 displayed increased affinity, with SEQ ID NO:1735 showing the greatest increase.

Itemized Listing of Embodiments

1. IL-1R-I binding polypeptide, comprising an IL-1R-I binding motif BM, which motif consists of an amino acid sequence selected from:

i)
(SEQ ID NO: 1686)
$EX_2X_3X_4X_5X_6X_7EIX_{10}X_{11}LPNLX_{16}RX_{18}QYX_{21}AFIX_{25}X_{26}LX_{28}D$ wherein, independently from each other, $X_2$ is selected from A, D, E, F, H, I, L, Q, S, T and V;

$X_3$ is selected from A, D, E, F, H, I, K, L, N, Q, R, S, T, V, W and Y;

$X_4$ is selected from A, D, E, F, H, I, K, L, M, N, Q, R, S, T, V, W and Y;

$X_5$ is selected from A, I and V;

$X_6$ is selected from F, H, I, Q, R, T, V and Y;

$X_7$ is selected from A, D, E, F, G, H, I, L, M, Q, S, T, V, W and Y;

$X_{10}$ is selected from F and Y;
$X_{11}$ is selected from A, D, E, F, G, H, I, K, L, M, N, Q, R, S, T, V, W and Y;
$X_{16}$ is selected from N and T;
$X_{18}$ is selected from K, R and S;
$X_{21}$ is selected from Q, T and V;
$X_{25}$ is selected from I, M, R, V and Y;
$X_{26}$ is selected from K and S, and
$X_{28}$ is selected from F, I, L and M,
and
ii) an amino acid sequence which has at least 96% identity to the sequence defined in i) provided that $X_5$ is I or V.

2. IL-1R-I binding polypeptide, wherein said IL-1R-I binding motif consists of an amino acid sequence selected from a sequence wherein in i)
$X_2$ is selected from A, I, L, T and V;
$X_3$ is selected from E and Y;
$X_4$ is selected from A, E, I, K, Q, R, T, V and Y;
$X_5$ is selected from I and V;
$X_6$ is selected from Q and Y;
$X_7$ is selected from F and M;
$X_{10}$ is selected from F and Y;
$X_{11}$ is selected from A, D, E, F, G, H, K, L, Q, R, S, T, V and Y;
$X_{16}$ is selected from N and T;
$X_{18}$ is selected from K and R;
$X_{21}$ is selected from T and V;
$X_{25}$ is selected from I and R;
$X_{26}$ is selected from K and S, and
$X_{28}$ is selected from F and L,
and an amino acid sequence which has at least 93% identity to the sequence defined in i).

3. IL-1R-I binding polypeptide according to any one of the preceding items, wherein sequence i) fulfills at least five of the ten conditions I-X:
I. $X_3$ is E;
II. $X_5$ is selected from I and V;
III. $X_6$ is selected from Q and Y;
IV. $X_7$ is selected from F and M;
V. $X_{10}$ is selected from F and Y;
VI. $X_{18}$ is selected from K and R;
VII. $X_{21}$ is T;
VIII. $X_{25}$ is R;
IX. $X_{26}$ is selected from K and S; and
X. $X_{28}$ is selected from F and L.

4. IL-1R-I binding polypeptide according to item 3, wherein sequence i) fulfills at least six of the ten conditions I-X.

5. IL-1R-I binding polypeptide according to item 4, wherein sequence i) fulfills at least seven of the ten conditions I-X.

6. IL-1R-I binding polypeptide according to item 5, wherein sequence i) fulfills at least eight of the ten conditions I-X.

7. IL-1R-I binding polypeptide according to item 6, wherein sequence i) fulfills at least nine of the ten conditions I-X.

8. IL-1R-I binding polypeptide according to item 7, wherein sequence i) fulfills all of the ten conditions I-X.

9. IL-1R-I binding polypeptide according to any one of items 1-8, wherein $X_2X_3X_6$ is VEQ or VEY.

10. IL-1R-I binding polypeptide according to any one of items 1-8, wherein $X_2X_3X_6$ is IEQ or VEQ.

11. IL-1R-I binding polypeptide according to any one of items 1-8, wherein $X_6X_{10}$ is selected from the group consisting of QF, QY, YF and YY.

12. IL-1R-I binding polypeptide according to any one of items 1-8, wherein $X_6X_{10}$ is QF.

13. IL-1R-I binding polypeptide according to any one of items 1-8, wherein $X_{10}X_{18}$ is selected from the group consisting of FK, FR, YK and YR.

14. IL-1R-I binding polypeptide according to any one of items 1-8, wherein $X_{10}X_{18}$ is FK or FR.

15. IL-1R-I binding polypeptide according to any one of items 1-8, wherein $X_{18}X_{25}X_{28}$ is KRL or RRL.

16. IL-1R-I binding polypeptide according to any one of items 1-8, wherein $X_5X_7$ is IM or VM.

17. IL-1R-I binding polypeptide according to any preceding item, wherein sequence i) corresponds to the sequence from position 8 to position 36 in a sequence selected from the group consisting of SEQ ID NO:1-1632, and 1679, such as the group consisting of SEQ ID NO:20-1632, and 1679.

18. IL-1R-I binding polypeptide according to any preceding item, wherein sequence i) corresponds to the sequence from position 8 to position 36 in a sequence selected from the group consisting of SEQ ID NO:1206-1632 and 1679, such as the group consisting of SEQ ID NO:1210-1632 and 1679.

19. IL-1R-I binding polypeptide according to any preceding item, wherein sequence i) corresponds to the sequence from position 8 to position 36 in a sequence selected from the group consisting of SEQ ID NO:1252, 1285, 1307, 1308, 1328, 1331, 1415, 1421, 1435, 1594 and 1679, such as the group consisting of SEQ ID NO:1252, 1328, 1435 and 1679.

20. IL-1R-I binding polypeptide according to item 19, wherein sequence i) corresponds to the sequence from position 8 to position 36 in SEQ ID NO:1252.

21. IL-1R-I binding polypeptide according to item 19, wherein sequence i) corresponds to the sequence from position 8 to position 36 in SEQ ID NO:1328.

22. IL-1R-I binding polypeptide according to item 19, wherein sequence i) corresponds to the sequence from position 8 to position 36 in SEQ ID NO:1435.

23. IL-1R-I binding polypeptide according to any preceding item, wherein said IL-1R-I binding motif forms part of a three-helix bundle protein domain.

24. IL-1R-I binding polypeptide according to item 23, wherein said IL-1R-I binding motif essentially forms part of two helices with an interconnecting loop, within said three-helix bundle protein domain.

25. IL-1R-I binding polypeptide according to item 24, wherein said three-helix bundle protein domain is selected from bacterial receptor domains.

26. IL-1R-I binding polypeptide according to item 25, wherein said three-helix bundle protein domain is selected from domains of protein A from *Staphylococcus aureus* or derivatives thereof.

27. IL-1R-I binding polypeptide according to any preceding item, which comprises a binding module BMod, the amino acid sequence of which is selected from:

iii)

(SEQ ID NO: 1687)

K-[*BM*]-DPSQS$X_aX_b$LL$X_c$EAKKL$X_dX_eX_f$Q;

wherein

[BM] is an IL-1R-I binding motif as defined in any one of items 1-22;

$X_a$ is selected from A and S;

$X_b$ is selected from N and E;

$X_c$ is selected from A, S and C;

$X_d$ is selected from E, N and S;
$X_e$ is selected from D, E and S;
$X_f$ is selected from A and S; and
iv) an amino acid sequence which has at least 91% identity to a sequence defined by iii).

28. IL-1R-I binding polypeptide according to any preceding item, wherein sequence iii) corresponds to the sequence from position 7 to position 55 in a sequence selected from the group consisting of SEQ ID NO:1-1638, 1667-1668 and 1670-1679; such as the group consisting of SEQ ID NO:20-1638 and 1670-1679.

29. IL-1R-I binding polypeptide according to item 28, wherein sequence iii) corresponds to the sequence from position 7 to position 55 in a sequence selected from the group consisting of SEQ ID NO:1206-1632 and 1670-1679, such as the group consisting of SEQ ID NO:1210-1632 and 1670-1679.

30. IL-1R-I binding polypeptide according to item 28, wherein sequence iii) corresponds to the sequence from position 7 to position 55 in a sequence selected from the group consisting of SEQ ID NO:1252, 1285, 1307, 1308, 1328, 1331, 1415, 1421, 1435, 1594 and 1670-1679, such as the group consisting of SEQ ID NO:1252, 1328, 1435, 1672, 1675-1676 and 1679.

31. IL-1R-I binding polypeptide according to item 30, wherein sequence iii) corresponds to the sequence from position 7 to position 55 in SEQ ID NO:1672.

32. IL-1R-I binding polypeptide according to item 30, wherein sequence iii) corresponds to the sequence from position 7 to position 55 in SEQ ID NO:1675.

33. IL-1R-I binding polypeptide according to item 30, wherein sequence iii) corresponds to the sequence from position 7 to position 55 in SEQ ID NO:1676.

34. IL-1R-I binding polypeptide according to any preceding item, which comprises an amino acid sequence selected from:

```
                                       SEQ ID NO: 1695
ADNNFNK-[BM]DPSQSANLLSEAKKLNESQAPK;

SEQ ID NO: 1696
ADNKFNK-[BM]DPSQSANLLAEAKKLNDAQAPK;

SEQ ID NO: 1697
ADNKFNK-[BM]DPSVSKEILAEAKKLNDAQAPK;

SEQ ID NO: 1698
ADAQQNNFNK-[BM]DPSQSTNVLGEAKKLNESQAPK;

SEQ ID NO: 1699
AQHDE-[BM]DPSQSANVLGEAQKLNDSQAPK;

SEQ ID NO: 1700
VDNKFNK-[BM]DPSQSANLLAEAKKLNDAQAPK;

SEQ ID NO: 1701
AEAKYAK-[BM]DPSESSELLSEAKKLNKSQAPK;

SEQ ID NO: 1702
VDAKYAK-[BM]DPSQSSELLAEAKKLNDAQAPK;

SEQ ID NO: 1703
VDAKYAK-[BM]DPSQSSELLAEAKKLNDSQAPK;

SEQ ID NO: 1704
AEAKYAK-[BM]DPSQSSELLSEAKKLNDSQAPK;

SEQ ID NO: 1705
AEAKYAK-[BM]DPSQSSELLSEAKKLNDSQAP;

SEQ ID NO: 1706
AEAKFAK-[BM]DPSQSSELLSEAKKLNDSQAPK;

SEQ ID NO: 1707
AEAKFAK-[BM]DPSQSSELLSEAKKLNDSQAP;

SEQ ID NO: 1708
AEAKYAK-[BM]DPSQSSELLAEAKKLNDAQAPK;

SEQ ID NO: 1709
AEAKYAK-[BM]DPSQSSELLSEAKKLSESQAPK;

SEQ ID NO: 1710
AEAKYAK-[BM]DPSQSSELLSEAKKLSESQAP;

SEQ ID NO: 1711
AEAKFAK-[BM]DPSQSSELLSEAKKLSESQAPK;

SEQ ID NO: 1712
AEAKFAK-[BM]DPSQSSELLSEAKKLSESQAP;

SEQ ID NO: 1713
AEAKYAK-[BM]DPSQSSELLAEAKKLSEAQAPK;

SEQ ID NO: 1714
AEAKYAK-[BM]DPSQSSELLSEAKKLESSQAPK;

SEQ ID NO: 1715
AEAKYAK-[BM]DPSQSSELLSEAKKLESSQAP;

SEQ ID NO: 1716
AEAKYAK-[BM]DPSQSSELLAEAKKLESAQAPK;

SEQ ID NO: 1717
AEAKYAK-[BM]DPSQSSELLSEAKKLSDSQAPK;

SEQ ID NO: 1718
AEAKYAK-[BM]DPSQSSELLSEAKKLSDSQAP;

SEQ ID NO: 1719
AEAKYAK-[BM]DPSQSSELLAEAKKLSDSQAPK;

SEQ ID NO: 1720
AEAKYAK-[BM]DPSQSSELLAEAKKLSDAQAPK;

SEQ ID NO: 1721
VDAKYAK-[BM]DPSQSSELLSEAKKLNDSQAPK;

SEQ ID NO: 1722
VDAKYAK-[BM]DPSQSSELLAEAKKLNDAQAPK;

SEQ ID NO: 1723
VDAKYAK-[BM]DPSQSSELLSEAKKLSESQAPK;

SEQ ID NO: 1724
VDAKYAK-[BM]DPSQSSELLAEAKKLSEAQAPK;

SEQ ID NO: 1725
VDAKYAK-[BM]DPSQSSELLSEAKKLESSQAPK;

SEQ ID NO: 1726
VDAKYAK-[BM]DPSQSSELLAEAKKLESAQAPK;

SEQ ID NO: 1727
VDAKYAK-[BM]DPSQSSELLSEAKKLSDSQAPK;

SEQ ID NO: 1728
VDAKYAK-[BM]DPSQSSELLAEAKKLSDSQAPK;

SEQ ID NO: 1729
VDAKYAK-[BM]DPSQSSELLAEAKKLSDAQAPK;

SEQ ID NO: 1730
VDAKYAK-[BM]DPSQSSELLAEAKKLNKAQAPK;

SEQ ID NO: 1731
AEAKYAK-[BM]DPSQSSELLAEAKKLNKAQAPK,
and

SEQ ID NO: 1732
ADAKYAK-[BM]DPSQSSELLSEAKKLNDSQAPK,
``` wherein [BM] is an IL-1R-I binding motif as defined in any one of items 1-22.

35. IL-1R-I binding polypeptide according to any one of items 1-34, which comprises an amino acid sequence selected from:

xix)
(SEQ ID NO: 1721)
VDAKYAK-[BM]-DPSQSSELLSEAKKLNDSQAPK wherein [BM] is an IL-1R-I binding motif as defined in any one of items 1-22; and xx) an amino acid sequence which in the sequences flanking the BM has at least 89% identity to the sequence defined in xix).

36. IL-1R-I binding polypeptide according to any one of items 1-34, which comprises an amino acid sequence selected from:

xxi)
(SEQ ID NO: 1709)
AEAKYAK-[BM]-DPSQSSELLSEAKKLSESQAPK;

wherein [BM] is an IL-1R-I binding motif as defined in any one of items 1-22; and xxii) an amino acid sequence which in the sequences flanking the BM has at least 89% identity to the sequence defined in xxi).

37. IL-1R-I binding polypeptide according to item 35 or 36, wherein sequence xix) or xxi) corresponds to the sequence from position 1 to position 58 in a sequence selected from the group consisting of SEQ ID NO:1-1632, 1667-1668 and 1670-1679; such as the group consisting of SEQ ID NO:20-1632, 1667-1668 and 1670-1679.

38. IL-1R-I binding polypeptide according to item 37 wherein xix) or xxi) corresponds to the sequence from position 1 to position 58 in a sequence selected from the group consisting SEQ ID NO:1206-1632, 1667-1668 and 1670-1679, such as the group consisting of SEQ ID NO:1210-1632, 1667-1668 and 1670-1679.

39. IL-1R-I binding polypeptide according to item 38, wherein sequence xix) or xxi) corresponds to the sequence from position 1 to position 58 in a sequence selected from the group consisting of SEQ ID NO:1252, 1285, 1307, 1308, 1328, 1331, 1415, 1421, 1435, 1594 and 1670-1679, such as the group consisting of SEQ ID NO:1252, 1328, 1435, 1672, 1675-1676 and 1679.

40. IL-1R-I binding polypeptide according to item 39, wherein sequence xxi) corresponds to the sequence from position 1 to position 58 in SEQ ID NO:1672.

41. IL-1R-I binding polypeptide according to item 39, wherein sequence xxi) corresponds to the sequence from position 1 to position 58 in SEQ ID NO:1675.

42. IL-1R-I binding polypeptide according to item 39, wherein sequence xxi) corresponds to the sequence from position 1 to position 58 in SEQ ID NO:1676.

43. IL-1R-I binding polypeptide according to any preceding item, which is capable of blocking IL-1R-I dependent signaling.

44. IL-1R-I binding polypeptide according to item 43, wherein the half maximal inhibitory concentration (IC$_{50}$) of the blocking is at most $1\times10^{-7}$ M, such as at most, $1\times10^{-8}$ M, such as at most $1\times10^{-9}$ M, such as at most $5\times10^{-10}$ M.

45. IL-1R-I binding polypeptide according to item 43 or 44, which is capable of blocking the interaction of IL-1R-I with IL-1 cytokines, such as the interaction of IL-1R-I with IL-1α and/or IL-1β.

46. IL-1R-I binding polypeptide according to any preceding item which is capable of binding to IL-1R-I such that the EC$_{50}$ value of the interaction is at most $1\times10^{-7}$ M, such as at most $1\times10^{-8}$ M, such as at most $5\times10^{-9}$ M, such as at most $1\times10^{-10}$ M such as at most $5\times10^{-10}$ M, such as at most $2\times10^{-10}$ M.

47. IL-1R-I binding polypeptide according to any preceding item which is capable of binding to IL-1R-I such that the K$_D$ value of the interaction is at most $1\times10^{-6}$ M, such as at most $1\times10^{-7}$ M, such as at most $1\times10^{-8}$ M, such as at most $1\times10^{-9}$ M, such as at most $9\times10^{-10}$.

48. IL-1R-I binding polypeptide according to any one of items 43-47, wherein said IL-1R-I is human IL-1R-I or cynomolgus IL-1R-I, such as human IL-1R-I.

49. IL-1R-I binding polypeptide according to any preceding item which comprises additional amino acids at the C-terminal and/or N-terminal end.

50. IL-1R-I binding polypeptide according to item 49, wherein said additional amino acid(s) improve(s) production, purification, stabilization in vivo or in vitro, coupling or detection of the polypeptide.

51. IL-1R-I binding polypeptide according to any preceding item in multimeric form, comprising at least two IL-1R-I binding polypeptide monomer units, the amino acid sequences of which are the same or different.

52. IL-1R-I binding polypeptide according to item 51, wherein said IL-1R-I binding polypeptide monomer units are covalently coupled together.

53. IL-1R-I binding polypeptide according to item 52, wherein the IL-1R-I binding polypeptide monomer units are expressed as a fusion protein.

54. IL-1R-I binding polypeptide according to any one of items 51-53, in dimeric form.

55. Fusion protein or conjugate comprising
a first moiety consisting of an IL-1R-I binding polypeptide according to any preceding item; and
a second moiety consisting of a polypeptide having a desired biological activity.

56. Fusion protein or conjugate according to item 55, wherein said desired biological activity is a therapeutic activity.

57. Fusion protein or conjugate according to item 55, wherein said desired biological activity is a binding activity.

58. Fusion protein or conjugate according to item 55, wherein said desired biological activity is a binding activity modifying tissue distribution of said fusion protein or conjugate.

59. Fusion protein or conjugate according to item 57, wherein said desired biological activity is an in vivo half-life increasing activity such that said second moiety increases in vivo half-life of the fusion protein or conjugate.

60. Fusion protein or conjugate according to item 59, said in vivo half-life increasing activity is an albumin binding activity.

61. Fusion protein or conjugate according to item 60, wherein said albumin binding activity is provided by the albumin binding domain of streptococcal protein G or a derivative thereof.

62. Fusion protein or conjugate according to item 61, wherein said second moiety comprises a polypeptide having an amino acid sequence as set out in SEQ ID NO:1659-1661, such as SEQ ID NO:1661.

63. Fusion protein or conjugate according to item 59, wherein said second moiety is serum albumin.
64. Fusion protein or conjugate according to item 59, wherein said second moiety is an Fc portion of an antibody, such as an IgG1 Fc or an IgG4 Fc.
65. Fusion protein or conjugate according to item 64, wherein said Fc is a mutated Fc which relative to an unmutated form of Fc displays improved affinity to FcRn and/or reduced effector response.
66. Fusion protein or conjugate according to item 58 or 59, wherein said second moiety is transferrin.
67. Fusion protein or conjugate according to any one of items 59-65, comprising a polypeptide having an amino acid sequence selected from the group consisting of SEQ ID NO:1639-1658 and 1734-1737, such as from the group consisting of SEQ ID NO:1646-1654 and 1734-1737.
68. Fusion protein or conjugate according to item 57, wherein said binding activity acts to block a biological activity.
69. Fusion protein or conjugate according to any one of items 55-68, further comprising at least one linker, said linker optionally being selected from the group consisting of flexible amino acid linkers, rigid amino acid linkers and cleavable amino acid linkers.
70. Fusion protein or conjugate according item 69, wherein said linker is arranged between said first moiety and said second moiety.
71. Fusion protein or conjugate according to item 69, wherein said linker is arranged within said first moiety.
72. Fusion protein or conjugate according item 69 or 70, wherein said linker is a flexible linker comprising at least one amino acid residue(s) selected from the group consisting of glycine, serine and alanine.
73. Fusion protein or conjugate according to item 72, wherein said linker is selected from the group consisting of GS, VDSS, VDGS, VEGS, ASGS, (GGGGS)$_2$ (SEQ ID NO:1683), AS(GGGGS)$_2$ (SEQ ID NO:1684) and ((KEAAA)$_3$KELAA)$_2$ (SEQ ID NO:1685).
74. Fusion protein or conjugate according to item 73, wherein said linker is selected from a AS(GGGGS)$_2$ (SEQ ID NO:1684) and ((KEAAA)$_3$KELAA)$_2$ (SEQ ID NO:1685).
75. A polynucleotide encoding a polypeptide or a fusion protein according to any one of items 1-74.
76. Expression vector comprising a polynucleotide according to item 75.
77. Host cell comprising an expression vector according to item 76.
78. Method of producing a polypeptide according to any one of items 1-77, comprising
culturing a host cell according to item 77 under conditions permissive of expression of said polypeptide from said expression vector, and
isolating said polypeptide.
79. Composition comprising an IL-1R-I binding polypeptide, fusion protein, or conjugate according to any one of items 1-74 and at least one pharmaceutically acceptable excipient or carrier.
80. Composition according to item 79, further comprising at least one additional active agent, such as an agent selected from an immune response modifying agent and an anti-cancer agent.
81. Composition according to item 79 or 80, wherein said fusion protein is a fusion protein according to any one of claims 59-67.
82. IL-1R-I binding polypeptide, fusion protein, or conjugate according to any one of items 1-74 or a composition according to any one of items 79-81 for use as a medicament, a diagnostic agent and/or a prognostic agent.
83. IL-1R-I binding polypeptide, fusion protein, conjugate or composition according to item 82 for use as a medicament.
84. IL-1R-I binding polypeptide, fusion protein, conjugate or composition for use according to item 83, wherein said polypeptide, fusion protein, conjugate or composition modulates IL-1R-I function in vivo.
85. IL-1R-I binding polypeptide, fusion protein, conjugate or composition according to item 82 for use as a diagnostic agent and/or a prognostic agent.
86. IL-1R-I binding polypeptide, fusion protein, conjugate or composition for use according to any one of items 82-85, in the treatment, prognosis or diagnosis of an IL-1R-I related disorder.
87. IL-1R-I binding polypeptide, fusion protein, conjugate or composition for use according to item 86, wherein said IL-1R-I related disorder is selected from the group consisting of inflammatory disease, autoinflammatory syndromes, autoimmune disease, infectious disease, cardiovascular disease, ischaemic disease, cancer and diabetes.
88. IL-1R-I binding polypeptide, fusion protein, conjugate or composition for use according to item 86 or 87, wherein said IL-1R-I related disorder is selected from the group consisting of familial Mediterranean fever (FMF); cryopyrin-associated periodic syndrome (CAPS); TNF receptor-associated periodic syndrome (TRAPS); hyper-IgD syndrome (HIDS); periodic fever; aphthous stomatitis; pharyngitis; adenitis (PFAPA); rheumatoid arthritis (RA), juvenile RA, juvenile idiopathic arthritis, systemic juvenile idiopathic arthritis; adult-onset Still's disease; Schnitzler syndrome; Muckle Wells Syndrome; macrophage activation syndrome; Behçet's disease; uveitis; acne vulgaris; pyoderma gangrenosum; gout; type 2 diabetes, new-onset diabetes; dry eye syndrome; hidradenitis suppurativa; neutrophilic dermatoses, in particular cytophagic histiocytic panniculitis, Weber-Christian disease, and neutrophilic panniculitis; cardiovascular disease, myocardial infarction, stroke; liver failure, kidney failure; acute lung injury; pseudogout, calcium-pyrophosphate deposition disorder, chondrocalcinosis, deficiency of the IL-1 receptor antagonist (DIRA), deficiency of the IL-36 receptor antagonist (DITRA), ADAM2 deficiency (DADA2), pyogenic arthritis, pyoderma gangrenosum and acne (PAPA) syndrome, pyoderma gangrenosum, acne and suppurative hidradenitis (PASH) syndrome, PAPA and suppurative hidradenitis (PAPASH) syndrome, autoinflammatory syndrome with lymphedema (AISLE), Phospholipase C-gamma-2 mutation autoinflammatory syndrome, NALP12-associated periodic syndrome (NAPS12), mevalonate kinase deficiency (MKD), psoriatic arthritis, reactive arthritis, ankylosing spondylitis, haemochromatosis-related arthritis, periarticular calcinosis, osteoarthritis, inflammatory osteoarthritis, hand osteoarthritis, pustular psoriasis such as generalised pustular psoriasis (GPP), palmoplantar pustulosis (PPP), acrodermatitis continua of Hallopeau (ACH); Blau syndrome; Sweet syndrome; various vasculitides such as giant-cell arteritis (GCA), polymyalgia rheumatica (PMR), Takayasu arteritis, Kawasaki disease, urticarial vasculitis, and Henoch-Schönlein purpura (HSP); neutrophilic urticaria and idiopathic cold urticaria; lichen planus; polymyositis, dermatomyositis, juvenile dermatomyositis and inclusion-body myositis; various stages of myeloma such as smoldering myeloma (SMM), indolent myeloma, Waldenstrom's macroglobulinemia, and multiple myeloma; tumor-induced cachexia; solid tumor growth; neonatal disorders such as bronchopulmonary dysplasia (prophylaxis), necrotising enterocolitis (NEC), retinopathy of prematurity (ROP), cerebral palsy due to perinatal cerebral ischemia, and infant respiratory distress syndrome (IRDS); Whipple's disease; traumatic brain injury; refractory epilepsy; systemic inflammatory response syndrome (SIRS); cutaneous lupus; Jessner-Kanof disease; amyotrophic lateral sclerosis; systemic sclerosis (scleroderma); septic shock; acute pancreatitis; chronic recurrent multifocal osteomyelitis, non-bacterial osteitis (NBO), synovitis, acne, pustulosis, hyperostosis, osteitis (SAPHO) syndrome, and Majeed syndrome; relapsing polychondritis; idiopathic recurrent pericarditis (IRP); myocarditis; Erdheim-Chester disease; juvenile xantogranuloma; islet-cell transplantation; haemodialysis-induced systemic inflammation; graft-versus-host disease; ANCA-associated glomerulonephritis and recurrent glomerulonephritis; Cogan syndrome; autoimmune inner-ear disease; chronic granulomatous disease (CGD); Castleman's disease; cardiac failure; diastolic cardiac failure; antisynthetase syndrome; acute ACL injury; acute haemorrhagic leukoencephalitis; AA amyloidosis; Di George syndrome; generalised fatigue; chronic fatigue syndrome (CFS); gulf-war illness (GWI); and narcolepsy.

89. IL-1R-I binding polypeptide, fusion protein, conjugate or composition for use according to item 87, wherein said IL-1R-I related disorder is cancer, such as a cancer selected from the group consisting of multiple myeloma, colon cancer, breast cancer, lung cancer, head and neck cancer, melanoma and prostate cancer.

90. IL-1R-I binding polypeptide, fusion protein, conjugate or composition for use according to any one of items 82-89, wherein said IL-1R-I binding polypeptide, fusion protein, conjugate or composition is administered repeatedly within a 24 hour period from disease onset, such as at least two times within a 24 hour period from disease onset, such as at least three times within a 24 hour period from disease onset, such as continuously during 24 hours from disease onset, to a subject in need thereof.

91. Fusion protein, conjugate or composition for use according to any one of items 82-84, 86-89, wherein said fusion protein or conjugate is a fusion protein or conjugate according to any one of items 58-67 and said composition is a composition according to item 81.

92. Fusion protein, conjugate or composition for use according to item 91, wherein said fusion protein, conjugate or composition is administered once weekly to a subject in need thereof.

93. Method of treatment of an IL-1R-I related disorder, comprising administering to a subject in need thereof an effective amount of an IL-1R-I binding polypeptide, fusion protein or conjugate according to any one of items 1-74 or a composition according to any one of items 79-81.

94. Method according to item 93, wherein said IL-1R-I related disorder is selected from the group consisting inflammatory disease, auto-inflammatory syndrome, autoimmune disease, infectious disease, cardiovascular disease, ischaemic disease, cancer and diabetes.

95. Method according to item 93 or 94, wherein said IL-1R-I related disorder is selected from the group as defined in item 88.

96. Method according to item 94, wherein said IL-1R-I related disorder is cancer, such as a cancer selected from the group consisting of selected from the group consisting of multiple myeloma, colon cancer, breast cancer, lung cancer, head and neck cancer, melanoma and prostate cancer.

97. Method according to any one of items 93-96, wherein said IL-1R-I binding polypeptide, fusion protein or conjugate or composition is administered repeatedly within a 24 h period from disease onset, such as at least two times within a 24 hour period from disease onset, such as at least three times within a 24 hour period from disease onset, such as continuously during 24 hours from disease onset, to a subject in need thereof.

98. Method according to any one of claims 93-96, wherein said fusion protein or conjugate is a fusion protein or conjugate according to any one of items 59-67 and said composition is a composition according to item 81.

99. Method according to item 97, wherein said fusion protein, conjugate or composition is administered once weekly to a subject in need thereof.

SEQUENCE LISTING (1737 sequences)

SEQ ID NO: 1 - protein, 58 aa, Artificial Sequence
  Engineered IL-1R-I binding polypeptide
VDAKYAKEAEDATMEIYNLPNLTRRQYVAFIIKLLDDPSQSSELLSEAKKLNDSQAPK

SEQ ID NO: 2 - protein, 58 aa, ARTIFICIAL SEQUENCE
  Engineered IL-1R-I binding polypeptide
VDAKYAKEAKTAQIEIYDLPNLTRRQYVAFIRKLLDDPSQSSELLSEAKKLNDSQAPK

SEQ ID NO: 3 - protein, 58 aa, ARTIFICIAL SEQUENCE
  Engineered IL-1R-I binding polypeptide
VDAKYAKEDEQAQLEIFNLPNLTRRQYTAFIRKLLDDPSQSSELLSEAKKLNDSQAPK

SEQ ID NO: 4 - protein, 58 aa, ARTIFICIAL SEQUENCE
  Engineered IL-1R-I binding polypeptide
VDAKYAKEVLYAYWEIFALPNLTRKQYTAFIRKLMDDPSQSSELLSEAKKLNDSQAPK

SEQ ID NO: 5 - protein, 58 aa, ARTIFICIAL SEQUENCE
  Engineered IL-1R-I binding polypeptide
VDAKYAKEVKWAHHEIFQLPNLTRKQYTAFIVKLFDDPSQSSELLSEAKKLNDSQAPK

SEQ ID NO: 6 - protein, 58 aa, ARTIFICIAL SEQUENCE
  Engineered IL-1R-I binding polypeptide
VDAKYAKEAHNAQQEIYRLPNLTRRQYTAFIIKLLDDPSQSSELLSEAKKLNDSQAPK

SEQ ID NO: 7 - protein, 58 aa, ARTIFICIAL SEQUENCE
  Engineered IL-1R-I binding polypeptide
VDAKYAKEARAAQGEIYALPNLTRRQYTAFIMKLLDDPSQSSELLSEAKKLNDSQAPK

SEQ ID NO: 8 - protein, 58 aa, ARTIFICIAL SEQUENCE
  Engineered IL-1R-I binding polypeptide
VDAKYAKEADHAQQEIFALPNLTRRQYTAFIIKLLDDPSQSSELLSEAKKLNDSQAPK

SEQ ID NO: 9 - protein, 58 aa, ARTIFICIAL SEQUENCE
  Engineered IL-1R-I binding polypeptide
VDAKYAKEAHRAQMEIFALPNLTRRQYTAFIRKLLDDPSQSSELLSEAKKLNDSQAPK

SEQ ID NO: 10 - protein, 58 aa, ARTIFICIAL SEQUENCE
  Engineered IL-1R-I binding polypeptide
VDAKYAKEALLAQQEIFALPNLTRRQYTAFIRKLLDDPSQSSELLSEAKKLNDSQAPK

SEQ ID NO: 11 - protein, 58 aa, ARTIFICIAL SEQUENCE
  Engineered IL-1R-I binding polypeptide
VDAKYAKEALSAQQEIFALPNLTRSQYTAFIRKLLDDPSQSSELLSEAKKLNDSQAPK

SEQ ID NO: 12 - protein, 58 aa, ARTIFICIAL SEQUENCE
  Engineered IL-1R-I binding polypeptide
VDAKYAKEALSAQQEIFALPNLTRRQYTAFIRKLLDDPSQSSELLSEAKKLNDSQAPK

SEQ ID NO: 13 - protein, 58 aa, ARTIFICIAL SEQUENCE
  Engineered IL-1R-I binding polypeptide
VDAKYAKEASLAQHEIFALPNLTRKQYTAFIRKLFDDPSQSSELLSEAKKLNDSQAPK

SEQ ID NO: 14 - protein, 58 aa, ARTIFICIAL SEQUENCE
  Engineered IL-1R-I binding polypeptide
VDAKYAKEAVYARDEIYLLPNLTRKQYTAFIRKLFDDPSQSSELLSEAKKLNDSQAPK

SEQ ID NO: 15 - protein, 58 aa, ARTIFICIAL SEQUENCE
  Engineered IL-1R-I binding polypeptide
VDAKYAKEARQAYAEIYLLPNLTRRQYTAFIRKLLDDPSQSSELLSEAKKLNDSQAPK

SEQ ID NO: 16 - protein, 58 aa, ARTIFICIAL SEQUENCE
  Engineered IL-1R-I binding polypeptide
VDAKYAKEARSAYAEIYGLPNLTRRQYTAFIIKLLDDPSQSSELLSEAKKLNDSQAPK

SEQ ID NO: 17 - protein, 58 aa, ARTIFICIAL SEQUENCE
  Engineered IL-1R-I binding polypeptide
VDAKYAKEQADAYAEIYSLPNLTRKQYVAFIRKLIDDPSQSSELLSEAKKLNDSQAPK

SEQ ID NO: 18 - protein, 58 aa, ARTIFICIAL SEQUENCE
  Engineered IL-1R-I binding polypeptide
VDAKYAKEHEKAILEIFHLPNLTRRQYTAFIRKLLDDPSQSSELLSEAKKLNDSQAPK

SEQ ID NO: 19 - protein, 58 aa, ARTIFICIAL SEQUENCE
  Engineered IL-1R-I binding polypeptide
VDAKYAKEQSQAYHEIFKLPNLTRRQYTAFIMKLLDDPSQSSELLSEAKKLNDSQAPK

SEQ ID NO: 20 - protein, 58 aa, ARTIFICIAL SEQUENCE
  Engineered IL-1R-I binding polypeptide
VDAKYAKEVTDAQLEIFALPNLTRKQYTAFIIKLLDDPSQSSELLSEAKKLNDSQAPK

SEQ ID NO: 21 - protein, 58 aa, ARTIFICIAL SEQUENCE
  Engineered IL-1R-I binding polypeptide
VDAKYAKEVEEAQMEIFELPNLTRKQYTAFIRKLLDDPSQSSELLSEAKKLNDSQAPK

SEQ ID NO: 22 - protein, 58 aa, ARTIFICIAL SEQUENCE
  Engineered IL-1R-I binding polypeptide
VDAKYAKEVESAQMEIFYLPNLTRKQYTAFIRKLLDDPSQSSELLSEAKKLNDSQAPK

SEQ ID NO: 23 - protein, 58 aa, ARTIFICIAL SEQUENCE
  Engineered IL-1R-I binding polypeptide
VDAKYAKEVDEAYMEIYRLPNLTRKQYTAFIRKLLDDPSQSSELLSEAKKLNDSQAPK

SEQ ID NO: 24 - protein, 58 aa, ARTIFICIAL SEQUENCE
  Engineered IL-1R-I binding polypeptide
VDAKYAKELENAYMEIYLLPNLTRKQYTAFIRKLLDDPSQSSELLSEAKKLNDSQAPK

SEQ ID NO: 25 - protein, 58 aa, ARTIFICIAL SEQUENCE
  Engineered IL-1R-I binding polypeptide
VDAKYAKELESAYMEIFNLPNLTRKQYTAFIRKLLDDPSQSSELLSEAKKLNDSQAPK

SEQ ID NO: 26 - protein, 58 aa, ARTIFICIAL SEQUENCE
  Engineered IL-1R-I binding polypeptide
VDAKYAKEVEEAQMEIFGLPNLTRRQYTAFIRKLLDDPSQSSELLSEAKKLNDSQAPK

SEQ ID NO: 27 - protein, 58 aa, ARTIFICIAL SEQUENCE
  Engineered IL-1R-I binding polypeptide
VDAKYAKETEDAQMEIFALPNLTRKQYTAFIRKLFDDPSQSSELLSEAKKLNDSQAPK

SEQ ID NO: 28 - protein, 58 aa, ARTIFICIAL SEQUENCE
  Engineered IL-1R-I binding polypeptide
VDAKYAKEVEQAQMEIYNLPNLTRKQYTAFIRKLFDDPSQSSELLSEAKKLNDSQAPK

SEQ ID NO: 29 - protein, 58 aa, ARTIFICIAL SEQUENCE
  Engineered IL-1R-I binding polypeptide
VDAKYAKEAYVAQMEIFALPNLTRRQYTAFIRKLLDDPSQSSELLSEAKKLNDSQAPK

SEQ ID NO: 30 - protein, 58 aa, ARTIFICIAL SEQUENCE
  Engineered IL-1R-I binding polypeptide
VDAKYAKEAYNAQMEIFGLPNLTRKQYTAFIRKLLDDPSQSSELLSEAKKLNDSQAPK

SEQ ID NO: 31 - protein, 58 aa, ARTIFICIAL SEQUENCE
  Engineered IL-1R-I binding polypeptide
VDAKYAKELEEAQMEIFYLPNLTRKQYTAFIRKLLDDPSQSSELLSEAKKLNDSQAPK

SEQ ID NO: 32 - protein, 58 aa, ARTIFICIAL SEQUENCE
  Engineered IL-1R-I binding polypeptide
VDAKYAKEIEAAQMEIFTLPNLTRKQYTAFIRKLLDDPSQSSELLSEAKKLNDSQAPK

SEQ ID NO: 33 - protein, 58 aa, ARTIFICIAL SEQUENCE
  Engineered IL-1R-I binding polypeptide
VDAKYAKEVEQAQMEIFALPNLTRRQYTAFIRKLLDDPSQSSELLSEAKKLNDSQAPK

SEQ ID NO: 34 - protein, 58 aa, ARTIFICIAL SEQUENCE
  Engineered IL-1R-I binding polypeptide
VDAKYAKEIEEAQMEIFALPNLTRKQYTAFIRKLFDDPSQSSELLSEAKKLNDSQAPK

SEQ ID NO: 35 - protein, 58 aa, ARTIFICIAL SEQUENCE
  Engineered IL-1R-I binding polypeptide
VDAKYAKETYNAQMEIFALPNLTRKQYTAFIRKLFDDPSQSSELLSEAKKLNDSQAPK

SEQ ID NO: 36 - protein, 58 aa, ARTIFICIAL SEQUENCE
  Engineered IL-1R-I binding polypeptide
VDAKYAKEVERAQMEIFDLPNLTRRQYTAFIRKLFDDPSQSSELLSEAKKLNDSQAPK

SEQ ID NO: 37 - protein, 58 aa, ARTIFICIAL SEQUENCE
  Engineered IL-1R-I binding polypeptide
VDAKYAKEIESAQMEIYYLPNLTRKQYTAFIRKLLDDPSQSSELLSEAKKLNDSQAPK

SEQ ID NO: 38 - protein, 58 aa, ARTIFICIAL SEQUENCE
  Engineered IL-1R-I binding polypeptide
VDAKYAKEVHAAQMEIFYLPNLTRKQYTAFIRKLFDDPSQSSELLSEAKKLNDSQAPK

SEQ ID NO: 39 - protein, 58 aa, ARTIFICIAL SEQUENCE
  Engineered IL-1R-I binding polypeptide
VDAKYAKETYEAQMEIFKLPNLTRKQYTAFIRKLLDDPSQSSELLSEAKKLNDSQAPK

SEQ ID NO: 40 - protein, 58 aa, ARTIFICIAL SEQUENCE
  Engineered IL-1R-I binding polypeptide
VDAKYAKEIEDAYMEIYGLPNLTRKQYTAFIRKLLDDPSQSSELLSEAKKLNDSQAPK

SEQ ID NO: 41 - protein, 58 aa, ARTIFICIAL SEQUENCE
  Engineered IL-1R-I binding polypeptide
VDAKYAKEAERAQMEIFDLPNLTRKQYTAFIRKLLDDPSQSSELLSEAKKLNDSQAPK

SEQ ID NO: 42 - protein, 58 aa, ARTIFICIAL SEQUENCE
  Engineered IL-1R-I binding polypeptide
VDAKYAKEVEIAQMEIFYLPNLTRRQYTAFIRKLLDDPSQSSELLSEAKKLNDSQAPK

SEQ ID NO: 43 - protein, 58 aa, ARTIFICIAL SEQUENCE
  Engineered IL-1R-I binding polypeptide
VDAKYAKEVEFAQMEIFKLPNLTRKQYTAFIRKLFDDPSQSSELLSEAKKLNDSQAPK

SEQ ID NO: 44 - protein, 58 aa, ARTIFICIAL SEQUENCE
  Engineered IL-1R-I binding polypeptide
VDAKYAKEVITAQMEIFYLPNLTRKQYTAFIRKLLDDPSQSSELLSEAKKLNDSQAPK

SEQ ID NO: 45 - protein, 58 aa, ARTIFICIAL SEQUENCE
  Engineered IL-1R-I binding polypeptide
VDAKYAKEIEEAQMEIYALPNLTRKQYTAFIRKLLDDPSQSSELLSEAKKLNDSQAPK

SEQ ID NO: 46 - protein, 58 aa, ARTIFICIAL SEQUENCE
  Engineered IL-1R-I binding polypeptide
VDAKYAKETEAAQMEIFSLPNLTRKQYTAFIRKLLDDPSQSSELLSEAKKLNDSQAPK

SEQ ID NO: 47 - protein, 58 aa, ARTIFICIAL SEQUENCE
  Engineered IL-1R-I binding polypeptide
VDAKYAKEIENAQMEIYYLPNLTRKQYTAFIRKLFDDPSQSSELLSEAKKLNDSQAPK

SEQ ID NO: 48 - protein, 58 aa, ARTIFICIAL SEQUENCE
  Engineered IL-1R-I binding polypeptide
VDAKYAKETVEAYEEIFHLPNLTRKQYTAFIRKLLDDPSQSSELLSEAKKLNDSQAPK

SEQ ID NO: 49 - protein, 58 aa, ARTIFICIAL SEQUENCE
  Engineered IL-1R-I binding polypeptide
VDAKYAKEVEVAQMEIFALPNLTRKQYTAFIRKLLDDPSQSSELLSEAKKLNDSQAPK

SEQ ID NO: 50 - protein, 58 aa, ARTIFICIAL SEQUENCE
  Engineered IL-1R-I binding polypeptide
VDAKYAKEVEDAYMEIYALPNLTRKQYTAFIRKLLDDPSQSSELLSEAKKLNDSQAPK

SEQ ID NO: 51 - protein, 58 aa, ARTIFICIAL SEQUENCE
  Engineered IL-1R-I binding polypeptide
VDAKYAKEIEVAQMEIFSLPNLTRKQYTAFIRKLLDDPSQSSELLSEAKKLNDSQAPK

SEQ ID NO: 52 - protein, 58 aa, ARTIFICIAL SEQUENCE
  Engineered IL-1R-I binding polypeptide
VDAKYAKEVEQAQMEIYGLPNLTRKQYTAFIRKLLDDPSQSSELLSEAKKLNDSQAPK

SEQ ID NO: 53 - protein, 58 aa, ARTIFICIAL SEQUENCE
  Engineered IL-1R-I binding polypeptide
VDAKYAKEVDQAYMEIYRLPNLTRKQYTAFIRKLLDDPSQSSELLSEAKKLNDSQAPK

SEQ ID NO: 54 - protein, 58 aa, ARTIFICIAL SEQUENCE
  Engineered IL-1R-I binding polypeptide
VDAKYAKEVEDAQMEIFKLPNLTRKQYTAFIRKLLDDPSQSSELLSEAKKLNDSQAPK

SEQ ID NO: 55 - protein, 58 aa, ARTIFICIAL SEQUENCE
  Engineered IL-1R-I binding polypeptide
VDAKYAKEIEEAQMEIFSLPNLTRKQYTAFIRKLLDDPSQSSELLSEAKKLNDSQAPK

SEQ ID NO: 56 - protein, 58 aa, ARTIFICIAL SEQUENCE
  Engineered IL-1R-I binding polypeptide
VDAKYAKEVYVAQMEIFGLPNLTRKQYTAFIRKLFDDPSQSSELLSEAKKLNDSQAPK

SEQ ID NO: 57 - protein, 58 aa, ARTIFICIAL SEQUENCE
  Engineered IL-1R-I binding polypeptide
VDAKYAKEIEEAQMEIFRLPNLTRKQYTAFIRKLFDDPSQSSELLSEAKKLNDSQAPK

SEQ ID NO: 58 - protein, 58 aa, ARTIFICIAL SEQUENCE
  Engineered IL-1R-I binding polypeptide
VDAKYAKEVEHAQMEIFYLPNLTRKQYTAFIRKLLDDPSQSSELLSEAKKLNDSQAPK

SEQ ID NO: 59 - protein, 58 aa, ARTIFICIAL SEQUENCE
  Engineered IL-1R-I binding polypeptide
VDAKYAKEIEIAQMEIFALPNLTRKQYTAFIRKLFDDPSQSSELLSEAKKLNDSQAPK

SEQ ID NO: 60 - protein, 58 aa, ARTIFICIAL SEQUENCE
  Engineered IL-1R-I binding polypeptide
VDAKYAKEVVEAYQEIFQLPNLTRKQYTAFIRKLLDDPSQSSELLSEAKKLNDSQAPK

SEQ ID NO: 61 - protein, 58 aa, ARTIFICIAL SEQUENCE
  Engineered IL-1R-I binding polypeptide
VDAKYAKEAEFAQMEIFELPNLTRRQYTAFIRKLLDDPSQSSELLSEAKKLNDSQAPK

SEQ ID NO: 62 - protein, 58 aa, ARTIFICIAL SEQUENCE
  Engineered IL-1R-I binding polypeptide
VDAKYAKEVELAQMEIFGLPNLTRKQYTAFIRKLLDDPSQSSELLSEAKKLNDSQAPK

SEQ ID NO: 63 - protein, 58 aa, ARTIFICIAL SEQUENCE
  Engineered IL-1R-I binding polypeptide
VDAKYAKEVEVAQMEIYGLPNLTRRQYTAFIRKLLDDPSQSSELLSEAKKLNDSQAPK

SEQ ID NO: 64 - protein, 58 aa, ARTIFICIAL SEQUENCE
  Engineered IL-1R-I binding polypeptide
VDAKYAKEIESAQMEIFNLPNLTRKQYTAFIRKLLDDPSQSSELLSEAKKLNDSQAPK

SEQ ID NO: 65 - protein, 58 aa, ARTIFICIAL SEQUENCE
  Engineered IL-1R-I binding polypeptide
VDAKYAKEVERAQFEIFALPNLTRKQYTAFIRKLFDDPSQSSELLSEAKKLNDSQAPK

SEQ ID NO: 66 - protein, 58 aa, ARTIFICIAL SEQUENCE
  Engineered IL-1R-I binding polypeptide
VDAKYAKEVKEAQDEIFALPNLTRKQYTAFIRKLFDDPSQSSELLSEAKKLNDSQAPK

SEQ ID NO: 67 - protein, 58 aa, ARTIFICIAL SEQUENCE
  Engineered IL-1R-I binding polypeptide
VDAKYAKEVEKAQMEIFNLPNLTRKQYTAFIRKLFDDPSQSSELLSEAKKLNDSQAPK

SEQ ID NO: 68 - protein, 58 aa, ARTIFICIAL SEQUENCE
  Engineered IL-1R-I binding polypeptide
VDAKYAKEVEFAQMEIFRLPNLTRKQYTAFIRKLLDDPSQSSELLSEAKKLNDSQAPK

SEQ ID NO: 69 - protein, 58 aa, ARTIFICIAL SEQUENCE
  Engineered IL-1R-I binding polypeptide
VDAKYAKEVEQAQMEIFALPNLTRKQYTAFIRKLFDDPSQSSELLSEAKKLNDSQAPK

SEQ ID NO: 70 - protein, 58 aa, ARTIFICIAL SEQUENCE
  Engineered IL-1R-I binding polypeptide
VDAKYAKEVENAQMEIFALPNLTRRQYTAFIRKLLDDPSQSSELLSEAKKLNDSQAPK

SEQ ID NO: 71 - protein, 58 aa, ARTIFICIAL SEQUENCE
  Engineered IL-1R-I binding polypeptide
VDAKYAKEVEIAQMEIFALPNLTRKQYTAFIRKLLDDPSQSSELLSEAKKLNDSQAPK

SEQ ID NO: 72 - protein, 58 aa, ARTIFICIAL SEQUENCE
  Engineered IL-1R-I binding polypeptide
VDAKYAKEIESAQMEIFALPNLTRKQYTAFIRKLLDDPSQSSELLSEAKKLNDSQAPK

SEQ ID NO: 73 - protein, 58 aa, ARTIFICIAL SEQUENCE
  Engineered IL-1R-I binding polypeptide
VDAKYAKEIENAQMEIFALPNLTRKQYTAFIRKLLDDPSQSSELLSEAKKLNDSQAPK

SEQ ID NO: 74 - protein, 58 aa, ARTIFICIAL SEQUENCE
  Engineered IL-1R-I binding polypeptide
VDAKYAKEIEDAQMEIYYLPNLTRKQYTAFIRKLLDDPSQSSELLSEAKKLNDSQAPK

SEQ ID NO: 75 - protein, 58 aa, ARTIFICIAL SEQUENCE
  Engineered IL-1R-I binding polypeptide
VDAKYAKELEKAQMEIYRLPNLTRRQYTAFIRKLFDDPSQSSELLSEAKKLNDSQAPK

SEQ ID NO: 76 - protein, 58 aa, ARTIFICIAL SEQUENCE
  Engineered IL-1R-I binding polypeptide
VDAKYAKETYEAQMEIFALPNLTRKQYTAFIRKLLDDPSQSSELLSEAKKLNDSQAPK

SEQ ID NO: 77 - protein, 58 aa, ARTIFICIAL SEQUENCE
  Engineered IL-1R-I binding polypeptide
VDAKYAKEVEWAQMEIFALPNLTRKQYTAFIRKLLDDPSQSSELLSEAKKLNDSQAPK

SEQ ID NO: 78 - protein, 58 aa, ARTIFICIAL SEQUENCE
  Engineered IL-1R-I binding polypeptide
VDAKYAKEVQAAQYEIFALPNLTRKQYTAFIRKLLDDPSQSSELLSEAKKLNDSQAPK

SEQ ID NO: 79 - protein, 58 aa, ARTIFICIAL SEQUENCE
  Engineered IL-1R-I binding polypeptide
VDAKYAKEVEYAQMEIFFLPNLTRKQYTAFIRKLLDDPSQSSELLSEAKKLNDSQAPK

SEQ ID NO: 80 - protein, 58 aa, ARTIFICIAL SEQUENCE
  Engineered IL-1R-I binding polypeptide
VDAKYAKEVELAYFEIYALPNLTRKQYTAFIRKLLDDPSQSSELLSEAKKLNDSQAPK

SEQ ID NO: 81 - protein, 58 aa, ARTIFICIAL SEQUENCE
  Engineered IL-1R-I binding polypeptide
VDAKYAKEVEKAQMEIFALPNLTRKQYTAFIRKLFDDPSQSSELLSEAKKLNDSQAPK

SEQ ID NO: 82 - protein, 58 aa, ARTIFICIAL SEQUENCE
  Engineered IL-1R-I binding polypeptide
VDAKYAKEAEIAQMEIFALPNLTRKQYTAFIRKLLDDPSQSSELLSEAKKLNDSQAPK

SEQ ID NO: 83 - protein, 58 aa, ARTIFICIAL SEQUENCE
  Engineered IL-1R-I binding polypeptide
VDAKYAKEVEKAYYEIFALPNLTRKQYTAFIRKLLDDPSQSSELLSEAKKLNDSQAPK

SEQ ID NO: 84 - protein, 58 aa, ARTIFICIAL SEQUENCE
  Engineered IL-1R-I binding polypeptide
VDAKYAKELEDAYFEIYYLPNLTRKQYTAFIRKLLDDPSQSSELLSEAKKLNDSQAPK

SEQ ID NO: 85 - protein, 58 aa, ARTIFICIAL SEQUENCE
  Engineered IL-1R-I binding polypeptide
VDAKYAKEVEEAQMEIFYLPNLTRKQYTAFIRKLLDDPSQSSELLSEAKKLNDSQAPK

SEQ ID NO: 86 - protein, 58 aa, ARTIFICIAL SEQUENCE
  Engineered IL-1R-I binding polypeptide
VDAKYAKEAADAYQEIFQLPNLTRKQYTAFIRKLLDDPSQSSELLSEAKKLNDSQAPK

SEQ ID NO: 87 - protein, 58 aa, ARTIFICIAL SEQUENCE
  Engineered IL-1R-I binding polypeptide
VDAKYAKEVEIAQMEIFGLPNLTRKQYTAFIRKLFDDPSQSSELLSEAKKLNDSQAPK

SEQ ID NO: 88 - protein, 58 aa, ARTIFICIAL SEQUENCE
  Engineered IL-1R-I binding polypeptide
VDAKYAKEVEIAQMEIFSLPNLTRKQYTAFIRKLLDDPSQSSELLSEAKKLNDSQAPK

SEQ ID NO: 89 - protein, 58 aa, ARTIFICIAL SEQUENCE
  Engineered IL-1R-I binding polypeptide
VDAKYAKEIEKAQMEIFRLPNLTRKQYTAFIRKLFDDPSQSSELLSEAKKLNDSQAPK

SEQ ID NO: 90 - protein, 58 aa, ARTIFICIAL SEQUENCE
  Engineered IL-1R-I binding polypeptide
VDAKYAKEVEEAQMEIFGLPNLTRKQYTAFIRKLFDDPSQSSELLSEAKKLNDSQAPK

SEQ ID NO: 91 - protein, 58 aa, ARTIFICIAL SEQUENCE
  Engineered IL-1R-I binding polypeptide
VDAKYAKETEIAQMEIFGLPNLTRKQYTAFIRKLLDDPSQSSELLSEAKKLNDSQAPK

SEQ ID NO: 92 - protein, 58 aa, ARTIFICIAL SEQUENCE
  Engineered IL-1R-I binding polypeptide
VDAKYAKEIHDAQMEIFGLPNLTRKQYTAFIRKLFDDPSQSSELLSEAKKLNDSQAPK

SEQ ID NO: 93 - protein, 58 aa, ARTIFICIAL SEQUENCE
  Engineered IL-1R-I binding polypeptide
VDAKYAKETEKAQMEIFGLPNLTRKQYTAFIRKLFDDPSQSSELLSEAKKLNDSQAPK

SEQ ID NO: 94 - protein, 58 aa, ARTIFICIAL SEQUENCE
  Engineered IL-1R-I binding polypeptide
VDAKYAKEVERAQMEIFALPNLTRKQYTAFIRKLLDDPSQSSELLSEAKKLNDSQAPK

SEQ ID NO: 95 - protein, 58 aa, ARTIFICIAL SEQUENCE
  Engineered IL-1R-I binding polypeptide
VDAKYAKEVKEAQMEIFVLPNLTRKQYTAFIRKLLDDPSQSSELLSEAKKLNDSQAPK

SEQ ID NO: 96 - protein, 58 aa, ARTIFICIAL SEQUENCE
  Engineered IL-1R-I binding polypeptide
VDAKYAKEVEDAQMEIFSLPNLTRKQYTAFIRKLLDDPSQSSELLSEAKKLNDSQAPK

SEQ ID NO: 97 - protein, 58 aa, ARTIFICIAL SEQUENCE
  Engineered IL-1R-I binding polypeptide
VDAKYAKEVEAAQMEIFSLPNLTRKQYTAFIRKLLDDPSQSSELLSEAKKLNDSQAPK

SEQ ID NO: 98 - protein, 58 aa, ARTIFICIAL SEQUENCE
  Engineered IL-1R-I binding polypeptide
VDAKYAKEAEKAYFEIYELPNLTRKQYTAFIRKLLDDPSQSSELLSEAKKLNDSQAPK

SEQ ID NO: 99 - protein, 58 aa, ARTIFICIAL SEQUENCE
  Engineered IL-1R-I binding polypeptide
VDAKYAKEIDKAYMEIFRLPNLTRKQYTAFIRKLLDDPSQSSELLSEAKKLNDSQAPK

SEQ ID NO: 100 - protein, 58 aa, ARTIFICIAL SEQUENCE
  Engineered IL-1R-I binding polypeptide
VDAKYAKETEYAQMEIFNLPNLTRKQYTAFIRKLLDDPSQSSELLSEAKKLNDSQAPK

SEQ ID NO: 101 - protein, 58 aa, ARTIFICIAL SEQUENCE
  Engineered IL-1R-I binding polypeptide
VDAKYAKEVEQAQMEIFHLPNLTRKQYTAFIRKLLDDPSQSSELLSEAKKLNDSQAPK

SEQ ID NO: 102 - protein, 58 aa, ARTIFICIAL SEQUENCE
  Engineered IL-1R-I binding polypeptide
VDAKYAKEVEIAQMEIFILPNLTRKQYTAFIRKLLDDPSQSSELLSEAKKLNDSQAPK

SEQ ID NO: 103 - protein, 58 aa, ARTIFICIAL SEQUENCE
  Engineered IL-1R-I binding polypeptide
VDAKYAKEIEQAQMEIFGLPNLTRKQYTAFIRKLLDDPSQSSELLSEAKKLNDSQAPK

SEQ ID NO: 104 - protein, 58 aa, ARTIFICIAL SEQUENCE
  Engineered IL-1R-I binding polypeptide
VDAKYAKELDEAYMEIFGLPNLTRKQYTAFIRKLLDDPSQSSELLSEAKKLNDSQAPK

SEQ ID NO: 105 - protein, 58 aa, ARTIFICIAL SEQUENCE
  Engineered IL-1R-I binding polypeptide
VDAKYAKETENAQMEIFALPNLTRKQYTAFIRKLLDDPSQSSELLSEAKKLNDSQAPK

SEQ ID NO: 106 - protein, 58 aa, ARTIFICIAL SEQUENCE
  Engineered IL-1R-I binding polypeptide
VDAKYAKEVESAQMEIFGLPNLTRKQYTAFIRKLFDDPSQSSELLSEAKKLNDSQAPK

SEQ ID NO: 107 - protein, 58 aa, ARTIFICIAL SEQUENCE
  Engineered IL-1R-I binding polypeptide
VDAKYAKEIENAQMEIFNLPNLTRKQYTAFIRKLFDDPSQSSELLSEAKKLNDSQAPK

SEQ ID NO: 108 - protein, 58 aa, ARTIFICIAL SEQUENCE
  Engineered IL-1R-I binding polypeptide
VDAKYAKEVIDAQMEIFNLPNLTRKQYTAFIRKLLDDPSQSSELLSEAKKLNDSQAPK

SEQ ID NO: 109 - protein, 58 aa, ARTIFICIAL SEQUENCE
  Engineered IL-1R-I binding polypeptide
VDAKYAKELYEAQMEIFALPNLTRKQYTAFIRKLFDDPSQSSELLSEAKKLNDSQAPK

SEQ ID NO: 110 - protein, 58 aa, ARTIFICIAL SEQUENCE
  Engineered IL-1R-I binding polypeptide
VDAKYAKEVETAQMEIFALPNLTRKQYTAFIRKLLDDPSQSSELLSEAKKLNDSQAPK

SEQ ID NO: 111 - protein, 58 aa, ARTIFICIAL SEQUENCE
  Engineered IL-1R-I binding polypeptide
VDAKYAKEVEFAQMEIYALPNLTRRQYTAFIRKLLDDPSQSSELLSEAKKLNDSQAPK

SEQ ID NO: 112 - protein, 58 aa, ARTIFICIAL SEQUENCE
  Engineered IL-1R-I binding polypeptide
VDAKYAKEVEEAQQEIFQLPNLTRKQYTAFIRKLFDDPSQSSELLSEAKKLNDSQAPK

SEQ ID NO: 113 - protein, 58 aa, ARTIFICIAL SEQUENCE
  Engineered IL-1R-I binding polypeptide
VDAKYAKEVESAQMEIYNLPNLTRRQYTAFIRKLLDDPSQSSELLSEAKKLNDSQAPK

SEQ ID NO: 114 - protein, 58 aa, ARTIFICIAL SEQUENCE
  Engineered IL-1R-I binding polypeptide
VDAKYAKETEQAQMEIFALPNLTRKQYTAFIRKLFDDPSQSSELLSEAKKLNDSQAPK

SEQ ID NO: 115 - protein, 58 aa, ARTIFICIAL SEQUENCE
  Engineered IL-1R-I binding polypeptide
VDAKYAKELEAAYFEIYELPNLTRKQYTAFIRKLLDDPSQSSELLSEAKKLNDSQAPK

SEQ ID NO: 116 - protein, 58 aa, ARTIFICIAL SEQUENCE
  Engineered IL-1R-I binding polypeptide
VDAKYAKEVEEAYMEIYNLPNLTRRQYTAFIRKLLDDPSQSSELLSEAKKLNDSQAPK

SEQ ID NO: 117 - protein, 58 aa, ARTIFICIAL SEQUENCE
  Engineered IL-1R-I binding polypeptide
VDAKYAKEVEVAYMEIYSLPNLTRKQYTAFIRKLLDDPSQSSELLSEAKKLNDSQAPK

SEQ ID NO: 118 - protein, 58 aa, ARTIFICIAL SEQUENCE
  Engineered IL-1R-I binding polypeptide
VDAKYAKEIEQAQMEIFALPNLTRKQYTAFIRKLFDDPSQSSELLSEAKKLNDSQAPK

SEQ ID NO: 119 - protein, 58 aa, ARTIFICIAL SEQUENCE
  Engineered IL-1R-I binding polypeptide
VDAKYAKEIEVAQMEIFALPNLTRKQYTAFIRKLLDDPSQSSELLSEAKKLNDSQAPK

SEQ ID NO: 120 - protein, 58 aa, ARTIFICIAL SEQUENCE
  Engineered IL-1R-I binding polypeptide
VDAKYAKEVEAAQMEIFVLPNLTRKQYTAFIRKLLDDPSQSSELLSEAKKLNDSQAPK

SEQ ID NO: 121 - protein, 58 aa, ARTIFICIAL SEQUENCE
  Engineered IL-1R-I binding polypeptide
VDAKYAKEVEAAQMEIYYLPNLTRKQYTAFIRKLLDDPSQSSELLSEAKKLNDSQAPK

SEQ ID NO: 122 - protein, 58 aa, ARTIFICIAL SEQUENCE
  Engineered IL-1R-I binding polypeptide
VDAKYAKEVETAQLEIFALPNLTRKQYTAFIRKLLDDPSQSSELLSEAKKLNDSQAPK

SEQ ID NO: 123 - protein, 58 aa, ARTIFICIAL SEQUENCE
  Engineered IL-1R-I binding polypeptide
VDAKYAKEAENAQMEIFSLPNLTRRQYTAFIRKLLDDPSQSSELLSEAKKLNDSQAPK

SEQ ID NO: 124 - protein, 58 aa, ARTIFICIAL SEQUENCE
  Engineered IL-1R-I binding polypeptide
VDAKYAKEIERAQHEIFNLPNLTRRQYTAFIRKLFDDPSQSSELLSEAKKLNDSQAPK

SEQ ID NO: 125 - protein, 58 aa, ARTIFICIAL SEQUENCE
  Engineered IL-1R-I binding polypeptide
VDAKYAKEVEEAQMEIFSLPNLTRKQYTAFIRKLFDDPSQSSELLSEAKKLNDSQAPK

SEQ ID NO: 126 - protein, 58 aa, ARTIFICIAL SEQUENCE
  Engineered IL-1R-I binding polypeptide
VDAKYAKELEAAQMEIFSLPNLTRKQYTAFIRKLFDDPSQSSELLSEAKKLNDSQAPK

SEQ ID NO: 127 - protein, 58 aa, ARTIFICIAL SEQUENCE
  Engineered IL-1R-I binding polypeptide
VDAKYAKEVVSAQMEIFALPNLTRKQYTAFIRKLFDDPSQSSELLSEAKKLNDSQAPK

SEQ ID NO: 128 - protein, 58 aa, ARTIFICIAL SEQUENCE
  Engineered IL-1R-I binding polypeptide
VDAKYAKEVEDAQMEIYSLPNLTRKQYTAFIRKLLDDPSQSSELLSEAKKLNDSQAPK

SEQ ID NO: 129 - protein, 58 aa, ARTIFICIAL SEQUENCE
  Engineered IL-1R-I binding polypeptide
VDAKYAKEVEEAQMEIFQLPNLTRKQYTAFIRKLLDDPSQSSELLSEAKKLNDSQAPK

SEQ ID NO: 130 - protein, 58 aa, ARTIFICIAL SEQUENCE
  Engineered IL-1R-I binding polypeptide
VDAKYAKEIEKAQMEIFKLPNLTRRQYTAFIRKLFDDPSQSSELLSEAKKLNDSQAPK

SEQ ID NO: 131 - protein, 58 aa, ARTIFICIAL SEQUENCE
  Engineered IL-1R-I binding polypeptide
VDAKYAKETYYAQMEIFTLPNLTRKQYTAFIRKLFDDPSQSSELLSEAKKLNDSQAPK

SEQ ID NO: 132 - protein, 58 aa, ARTIFICIAL SEQUENCE
  Engineered IL-1R-I binding polypeptide
VDAKYAKETYEAQMEIFALPNLTRRQYTAFIRKLLDDPSQSSELLSEAKKLNDSQAPK

SEQ ID NO: 133 - protein, 58 aa, ARTIFICIAL SEQUENCE
  Engineered IL-1R-I binding polypeptide
VDAKYAKEIEEAQMEIFELPNLTRKQYTAFIRKLLDDPSQSSELLSEAKKLNDSQAPK

SEQ ID NO: 134 - protein, 58 aa, ARTIFICIAL SEQUENCE
  Engineered IL-1R-I binding polypeptide
VDAKYAKEVQEAQMEIFALPNLTRKQYTAFIRKLFDDPSQSSELLSEAKKLNDSQAPK

SEQ ID NO: 135 - protein, 58 aa, ARTIFICIAL SEQUENCE
  Engineered IL-1R-I binding polypeptide
VDAKYAKEIEEAQMEIFYLPNLTRKQYTAFIRKLLDDPSQSSELLSEAKKLNDSQAPK

SEQ ID NO: 136 - protein, 58 aa, ARTIFICIAL SEQUENCE
  Engineered IL-1R-I binding polypeptide
VDAKYAKELEAAYMEIYYLPNLTRKQYTAFIRKLLDDPSQSSELLSEAKKLNDSQAPK

SEQ ID NO: 137 - protein, 58 aa, ARTIFICIAL SEQUENCE
  Engineered IL-1R-I binding polypeptide
VDAKYAKETERAQMEIFALPNLTRRQYTAFIRKLLDDPSQSSELLSEAKKLNDSQAPK

SEQ ID NO: 138 - protein, 58 aa, ARTIFICIAL SEQUENCE
  Engineered IL-1R-I binding polypeptide
VDAKYAKEIEHAQMEIFALPNLTRKQYTAFIRKLLDDPSQSSELLSEAKKLNDSQAPK

SEQ ID NO: 139 - protein, 58 aa, ARTIFICIAL SEQUENCE
  Engineered IL-1R-I binding polypeptide
VDAKYAKEVEDAQMEIFALPNLTRRQYTAFIRKLLDDPSQSSELLSEAKKLNDSQAPK

SEQ ID NO: 140 - protein, 58 aa, ARTIFICIAL SEQUENCE
  Engineered IL-1R-I binding polypeptide
VDAKYAKEVEAAQMEIFALPNLTRKQYTAFIRKLLDDPSQSSELLSEAKKLNDSQAPK

SEQ ID NO: 141 - protein, 58 aa, ARTIFICIAL SEQUENCE
  Engineered IL-1R-I binding polypeptide
VDAKYAKEVVAAYQEIYQLPNLTRRQYTAFIRKLLDDPSQSSELLSEAKKLNDSQAPK

SEQ ID NO: 142 - protein, 58 aa, ARTIFICIAL SEQUENCE
  Engineered IL-1R-I binding polypeptide
VDAKYAKETYAAQMEIFNLPNLTRKQYTAFIRKLFDDPSQSSELLSEAKKLNDSQAPK

SEQ ID NO: 143 - protein, 58 aa, ARTIFICIAL SEQUENCE
  Engineered IL-1R-I binding polypeptide
VDAKYAKEVEQAQMEIFALPNLTRKQYTAFIRKLLDDPSQSSELLSEAKKLNDSQAPK

SEQ ID NO: 144 - protein, 58 aa, ARTIFICIAL SEQUENCE
  Engineered IL-1R-I binding polypeptide
VDAKYAKEIEKAQMEIYQLPNLTRKQYTAFIRKLFDDPSQSSELLSEAKKLNDSQAPK

SEQ ID NO: 145 - protein, 58 aa, ARTIFICIAL SEQUENCE
  Engineered IL-1R-I binding polypeptide
VDAKYAKEAEVAYFEIYKLPNLTRKQYTAFIRKLLDDPSQSSELLSEAKKLNDSQAPK

SEQ ID NO: 146 - protein, 58 aa, ARTIFICIAL SEQUENCE
  Engineered IL-1R-I binding polypeptide
VDAKYAKEAIDAYDEIYALPNLTRKQYTAFIRKLLDDPSQSSELLSEAKKLNDSQAPK

SEQ ID NO: 147 - protein, 58 aa, ARTIFICIAL SEQUENCE
  Engineered IL-1R-I binding polypeptide
VDAKYAKEVEDAQMEIYFLPNLTRKQYTAFIRKLFDDPSQSSELLSEAKKLNDSQAPK

SEQ ID NO: 148 - protein, 58 aa, ARTIFICIAL SEQUENCE
  Engineered IL-1R-I binding polypeptide
VDAKYAKEIENAQMEIFYLPNLTRKQYTAFIRKLFDDPSQSSELLSEAKKLNDSQAPK

SEQ ID NO: 149 - protein, 58 aa, ARTIFICIAL SEQUENCE
  Engineered IL-1R-I binding polypeptide
VDAKYAKEVDDAYMEIFRLPNLTRRQYTAFIRKLLDDPSQSSELLSEAKKLNDSQAPK

SEQ ID NO: 150 - protein, 58 aa, ARTIFICIAL SEQUENCE
  Engineered IL-1R-I binding polypeptide
VDAKYAKEVEEAQMEIFSLPNLTRKQYTAFIRKLLDDPSQSSELLSEAKKLNDSQAPK

SEQ ID NO: 151 - protein, 58 aa, ARTIFICIAL SEQUENCE
  Engineered IL-1R-I binding polypeptide
VDAKYAKEVESAQMEIFKLPNLTRRQYTAFIRKLLDDPSQSSELLSEAKKLNDSQAPK

SEQ ID NO: 152 - protein, 58 aa, ARTIFICIAL SEQUENCE
  Engineered IL-1R-I binding polypeptide
VDAKYAKETEIAQMEIFALPNLTRKQYTAFIRKLLDDPSQSSELLSEAKKLNDSQAPK

SEQ ID NO: 153 - protein, 58 aa, ARTIFICIAL SEQUENCE
  Engineered IL-1R-I binding polypeptide
VDAKYAKEVERAQMEIFDLPNLTRKQYTAFIRKLLDDPSQSSELLSEAKKLNDSQAPK

SEQ ID NO: 154 - protein, 58 aa, ARTIFICIAL SEQUENCE
  Engineered IL-1R-I binding polypeptide
VDAKYAKETETAQMEIFALPNLTRKQYTAFIRKLLDDPSQSSELLSEAKKLNDSQAPK

SEQ ID NO: 155 - protein, 58 aa, ARTIFICIAL SEQUENCE
  Engineered IL-1R-I binding polypeptide
VDAKYAKEIEYAQMEIFALPNLTRKQYTAFIRKLFDDPSQSSELLSEAKKLNDSQAPK

SEQ ID NO: 156 - protein, 58 aa, ARTIFICIAL SEQUENCE
  Engineered IL-1R-I binding polypeptide
VDAKYAKELERAQMEIYHLPNLTRKQYTAFIRKLFDDPSQSSELLSEAKKLNDSQAPK

SEQ ID NO: 157 - protein, 58 aa, ARTIFICIAL SEQUENCE
  Engineered IL-1R-I binding polypeptide
VDAKYAKESEIAQMEIFALPNLTRRQYTAFIRKLLDDPSQSSELLSEAKKLNDSQAPK

SEQ ID NO: 158 - protein, 58 aa, ARTIFICIAL SEQUENCE
  Engineered IL-1R-I binding polypeptide
VDAKYAKETEKAQMEIFALPNLTRKQYTAFIRKLLDDPSQSSELLSEAKKLNDSQAPK

SEQ ID NO: 159 - protein, 58 aa, ARTIFICIAL SEQUENCE
  Engineered IL-1R-I binding polypeptide
VDAKYAKEVENAQMEIFNLPNLTRKQYTAFIRKLLDDPSQSSELLSEAKKLNDSQAPK

SEQ ID NO: 160 - protein, 58 aa, ARTIFICIAL SEQUENCE
  Engineered IL-1R-I binding polypeptide
VDAKYAKEVEEAQLEIFALPNLTRKQYTAFIRKLLDDPSQSSELLSEAKKLNDSQAPK

SEQ ID NO: 161 - protein, 58 aa, ARTIFICIAL SEQUENCE
  Engineered IL-1R-I binding polypeptide
VDAKYAKEVKEAQLEIFALPNLTRKQYTAFIRKLLDDPSQSSELLSEAKKLNDSQAPK

SEQ ID NO: 162 - protein, 58 aa, ARTIFICIAL SEQUENCE
  Engineered IL-1R-I binding polypeptide
VDAKYAKEVQEAQMEIFALPNLTRKQYTAFIRKLLDDPSQSSELLSEAKKLNDSQAPK

SEQ ID NO: 163 - protein, 58 aa, ARTIFICIAL SEQUENCE
  Engineered IL-1R-I binding polypeptide
VDAKYAKEVQFAYMEIFHLPNLTRRQYTAFIRKLLDDPSQSSELLSEAKKLNDSQAPK

SEQ ID NO: 164 - protein, 58 aa, ARTIFICIAL SEQUENCE
  Engineered IL-1R-I binding polypeptide
VDAKYAKELEHAYMEIYALPNLTRKQYTAFIRKLLDDPSQSSELLSEAKKLNDSQAPK

SEQ ID NO: 165 - protein, 58 aa, ARTIFICIAL SEQUENCE
  Engineered IL-1R-I binding polypeptide
VDAKYAKETEAAQMEIFALPNLTRKQYTAFIRKLLDDPSQSSELLSEAKKLNDSQAPK

SEQ ID NO: 166 - protein, 58 aa, ARTIFICIAL SEQUENCE
  Engineered IL-1R-I binding polypeptide
VDAKYAKEVETAQMEIFALPNLTRKQYTAFIRKLFDDPSQSSELLSEAKKLNDSQAPK

SEQ ID NO: 167 - protein, 58 aa, ARTIFICIAL SEQUENCE
  Engineered IL-1R-I binding polypeptide
VDAKYAKELEKAQMEIYYLPNLTRRQYTAFIRKLLDDPSQSSELLSEAKKLNDSQAPK

SEQ ID NO: 168 - protein, 58 aa, ARTIFICIAL SEQUENCE
  Engineered IL-1R-I binding polypeptide
VDAKYAKEIEEAQMEIYDLPNLTRKQYTAFIRKLFDDPSQSSELLSEAKKLNDSQAPK

SEQ ID NO: 169 - protein, 58 aa, ARTIFICIAL SEQUENCE
  Engineered IL-1R-I binding polypeptide
VDAKYAKELESAYMEIYSLPNLTRKQYTAFIRKLLDDPSQSSELLSEAKKLNDSQAPK

SEQ ID NO: 170 - protein, 58 aa, ARTIFICIAL SEQUENCE
  Engineered IL-1R-I binding polypeptide
VDAKYAKEIEVAQMEIFSLPNLTRKQYTAFIRKLFDDPSQSSELLSEAKKLNDSQAPK

SEQ ID NO: 171 - protein, 58 aa, ARTIFICIAL SEQUENCE
  Engineered IL-1R-I binding polypeptide
VDAKYAKEVELAQMEIFELPNLTRKQYTAFIRKLLDDPSQSSELLSEAKKLNDSQAPK

SEQ ID NO: 172 - protein, 58 aa, ARTIFICIAL SEQUENCE
  Engineered IL-1R-I binding polypeptide
VDAKYAKEIEEAQMEIFTLPNLTRKQYTAFIRKLLDDPSQSSELLSEAKKLNDSQAPK

SEQ ID NO: 173 - protein, 58 aa, ARTIFICIAL SEQUENCE
  Engineered IL-1R-I binding polypeptide
VDAKYAKEIEAAQMEIYYLPNLTRKQYTAFIIKLLDDPSQSSELLSEAKKLNDSQAPK

SEQ ID NO: 174 - protein, 58 aa, ARTIFICIAL SEQUENCE
  Engineered IL-1R-I binding polypeptide
VDAKYAKEIEEAYMEIYNLPNLTRKQYTAFIRKLLDDPSQSSELLSEAKKLNDSQAPK

SEQ ID NO: 175 - protein, 58 aa, ARTIFICIAL SEQUENCE
  Engineered IL-1R-I binding polypeptide
VDAKYAKEVEFAQLEIFSLPNLTRKQYTAFIRKLFDDPSQSSELLSEAKKLNDSQAPK

SEQ ID NO: 176 - protein, 58 aa, ARTIFICIAL SEQUENCE
  Engineered IL-1R-I binding polypeptide
VDAKYAKEIEEAQMEIFALPNLTRKQYTAFIRKLLDDPSQSSELLSEAKKLNDSQAPK

SEQ ID NO: 177 - protein, 58 aa, ARTIFICIAL SEQUENCE
  Engineered IL-1R-I binding polypeptide
VDAKYAKEVEQAQMEIFYLPNLTRKQYTAFIRKLLDDPSQSSELLSEAKKLNDSQAPK

SEQ ID NO: 178 - protein, 58 aa, ARTIFICIAL SEQUENCE
  Engineered IL-1R-I binding polypeptide
VDAKYAKEAFTAQMEIFGLPNLTRKQYTAFIRKLLDDPSQSSELLSEAKKLNDSQAPK

SEQ ID NO: 179 - protein, 58 aa, ARTIFICIAL SEQUENCE
  Engineered IL-1R-I binding polypeptide
VDAKYAKETHQAQMEIFALPNLTRKQYTAFIRKLLDDPSQSSELLSEAKKLNDSQAPK

SEQ ID NO: 180 - protein, 58 aa, ARTIFICIAL SEQUENCE
  Engineered IL-1R-I binding polypeptide
VDAKYAKEVEDAQMEIFALPNLTRKQYTAFIRKLLDDPSQSSELLSEAKKLNDSQAPK

SEQ ID NO: 181 - protein, 58 aa, ARTIFICIAL SEQUENCE
  Engineered IL-1R-I binding polypeptide
VDAKYAKEVEQAQMEIYVLPNLTRKQYTAFIRKLLDDPSQSSELLSEAKKLNDSQAPK

SEQ ID NO: 182 - protein, 58 aa, ARTIFICIAL SEQUENCE
  Engineered IL-1R-I binding polypeptide
VDAKYAKEVEAAQMEIFNLPNLTRKQYTAFIRKLLDDPSQSSELLSEAKKLNDSQAPK

SEQ ID NO: 183 - protein, 58 aa, ARTIFICIAL SEQUENCE
  Engineered IL-1R-I binding polypeptide
VDAKYAKEVEEAQMEIFSLPNLTRRQYTAFIRKLLDDPSQSSELLSEAKKLNDSQAPK

SEQ ID NO: 184 - protein, 58 aa, ARTIFICIAL SEQUENCE
  Engineered IL-1R-I binding polypeptide
VDAKYAKEIEEAQMEIYALPNLTRKQYTAFIRKLFDDPSQSSELLSEAKKLNDSQAPK

SEQ ID NO: 185 - protein, 58 aa, ARTIFICIAL SEQUENCE
  Engineered IL-1R-I binding polypeptide
VDAKYAKEIEQAQMEIFHLPNLTRKQYTAFIRKLLDDPSQSSELLSEAKKLNDSQAPK

SEQ ID NO: 186 - protein, 58 aa, ARTIFICIAL SEQUENCE
  Engineered IL-1R-I binding polypeptide
VDAKYAKETEEAQMEIFALPNLTRRQYTAFIRKLLDDPSQSSELLSEAKKLNDSQAPK

SEQ ID NO: 187 - protein, 58 aa, ARTIFICIAL SEQUENCE
  Engineered IL-1R-I binding polypeptide
VDAKYAKEIERAQMEIFALPNLTRKQYTAFIRKLLDDPSQSSELLSEAKKLNDSQAPK

SEQ ID NO: 188 - protein, 58 aa, ARTIFICIAL SEQUENCE
  Engineered IL-1R-I binding polypeptide
VDAKYAKELESAQMEIYELPNLTRKQYTAFIRKLLDDPSQSSELLSEAKKLNDSQAPK

SEQ ID NO: 189 - protein, 58 aa, ARTIFICIAL SEQUENCE
  Engineered IL-1R-I binding polypeptide
VDAKYAKEVEAAQMEIFYLPNLTRKQYTAFIRKLLDDPSQSSELLSEAKKLNDSQAPK

SEQ ID NO: 190 - protein, 58 aa, ARTIFICIAL SEQUENCE
  Engineered IL-1R-I binding polypeptide
VDAKYAKEVEEAQMEIFGLPNLTRKQYTAFIRKLLDDPSQSSELLSEAKKLNDSQAPK

SEQ ID NO: 191 - protein, 58 aa, ARTIFICIAL SEQUENCE
  Engineered IL-1R-I binding polypeptide
VDAKYAKEVEEAQMEIYYLPNLTRKQYTAFIRKLLDDPSQSSELLSEAKKLNDSQAPK

SEQ ID NO: 192 - protein, 58 aa, ARTIFICIAL SEQUENCE
  Engineered IL-1R-I binding polypeptide
VDAKYAKEVEKAQMEIFGLPNLTRKQYTAFIRKLFDDPSQSSELLSEAKKLNDSQAPK

SEQ ID NO: 193 - protein, 58 aa, ARTIFICIAL SEQUENCE
  Engineered IL-1R-I binding polypeptide
VDAKYAKEVEQAYMEIYNLPNLTRKQYTAFIRKLLDDPSQSSELLSEAKKLNDSQAPK

SEQ ID NO: 194 - protein, 58 aa, ARTIFICIAL SEQUENCE
  Engineered IL-1R-I binding polypeptide
VDAKYAKELEHAYHEIYILPNLTRKQYTAFIRKLLDDPSQSSELLSEAKKLNDSQAPK

SEQ ID NO: 195 - protein, 58 aa, ARTIFICIAL SEQUENCE
  Engineered IL-1R-I binding polypeptide
VDAKYAKEIEEAQMEIFNLPNLTRKQYTAFIRKLLDDPSQSSELLSEAKKLNDSQAPK

SEQ ID NO: 196 - protein, 58 aa, ARTIFICIAL SEQUENCE
  Engineered IL-1R-I binding polypeptide
VDAKYAKEVEDAQQEIFHLPNLTRKQYTAFIRKLLDDPSQSSELLSEAKKLNDSQAPK

SEQ ID NO: 197 - protein, 58 aa, ARTIFICIAL SEQUENCE
  Engineered IL-1R-I binding polypeptide
VDAKYAKEIEIAQMEIYALPNLTRKQYTAFIRKLFDDPSQSSELLSEAKKLNDSQAPK

SEQ ID NO: 198 - protein, 58 aa, ARTIFICIAL SEQUENCE
  Engineered IL-1R-I binding polypeptide
VDAKYAKEVEWAQMEIFSLPNLTRKQYTAFIRKLLDDPSQSSELLSEAKKLNDSQAPK

SEQ ID NO: 199 - protein, 58 aa, ARTIFICIAL SEQUENCE
  Engineered IL-1R-I binding polypeptide
VDAKYAKEVLDAQMEIFGLPNLTRKQYTAFIRKLLDDPSQSSELLSEAKKLNDSQAPK

SEQ ID NO: 200 - protein, 58 aa, ARTIFICIAL SEQUENCE
  Engineered IL-1R-I binding polypeptide
VDAKYAKEVESAQMEIFNLPNLTRKQYTAFIRKLFDDPSQSSELLSEAKKLNDSQAPK

SEQ ID NO: 201 - protein, 58 aa, ARTIFICIAL SEQUENCE
  Engineered IL-1R-I binding polypeptide
VDAKYAKEIEEAQMEIFQLPNLTRKQYTAFIRKLLDDPSQSSELLSEAKKLNDSQAPK

SEQ ID NO: 202 - protein, 58 aa, ARTIFICIAL SEQUENCE
  Engineered IL-1R-I binding polypeptide
VDAKYAKEIEDAQMEIFYLPNLTRKQYTAFIRKLLDDPSQSSELLSEAKKLNDSQAPK

SEQ ID NO: 203 - protein, 58 aa, ARTIFICIAL SEQUENCE
  Engineered IL-1R-I binding polypeptide
VDAKYAKEVEIAYMEIFHLPNLTRKQYTAFIRKLLDDPSQSSELLSEAKKLNDSQAPK

SEQ ID NO: 204 - protein, 58 aa, ARTIFICIAL SEQUENCE
  Engineered IL-1R-I binding polypeptide
VDAKYAKEAYRAQMEIFALPNLTRKQYTAFIRKLLDDPSQSSELLSEAKKLNDSQAPK

SEQ ID NO: 205 - protein, 58 aa, ARTIFICIAL SEQUENCE
  Engineered IL-1R-I binding polypeptide
VDAKYAKEVELAQMEIFSLPNLTRKQYTAFIRKLLDDPSQSSELLSEAKKLNDSQAPK

SEQ ID NO: 206 - protein, 58 aa, ARTIFICIAL SEQUENCE
  Engineered IL-1R-I binding polypeptide
VDAKYAKETEHAQMEIYNLPNLTRKQYTAFIRKLFDDPSQSSELLSEAKKLNDSQAPK

SEQ ID NO: 207 - protein, 58 aa, ARTIFICIAL SEQUENCE
  Engineered IL-1R-I binding polypeptide
VDAKYAKEVYIAQMEIYGLPNLTRKQYTAFIRKLFDDPSQSSELLSEAKKLNDSQAPK

SEQ ID NO: 208 - protein, 58 aa, ARTIFICIAL SEQUENCE
  Engineered IL-1R-I binding polypeptide
VDAKYAKEVEVAQMEIFSLPNLTRKQYTAFIRKLLDDPSQSSELLSEAKKLNDSQAPK

SEQ ID NO: 209 - protein, 58 aa, ARTIFICIAL SEQUENCE
  Engineered IL-1R-I binding polypeptide
VDAKYAKELEDAQMEIFKLPNLTRKQYTAFIRKLFDDPSQSSELLSEAKKLNDSQAPK

SEQ ID NO: 210 - protein, 58 aa, ARTIFICIAL SEQUENCE
  Engineered IL-1R-I binding polypeptide
VDAKYAKEIEQAQMEIFALPNLTRKQYTAFIIKLFDDPSQSSELLSEAKKLNDSQAPK

SEQ ID NO: 211 - protein, 58 aa, ARTIFICIAL SEQUENCE
  Engineered IL-1R-I binding polypeptide
VDAKYAKEVEIAQMEIFSLPNLTRKQYTAFIRKLFDDPSQSSELLSEAKKLNDSQAPK

SEQ ID NO: 212 - protein, 58 aa, ARTIFICIAL SEQUENCE
  Engineered IL-1R-I binding polypeptide
VDAKYAKEVEVAQMEIFNLPNLTRRQYTAFIRKLLDDPSQSSELLSEAKKLNDSQAPK

SEQ ID NO: 213 - protein, 58 aa, ARTIFICIAL SEQUENCE
  Engineered IL-1R-I binding polypeptide
VDAKYAKEVEEAQLEIFGLPNLTRKQYTAFIRKLLDDPSQSSELLSEAKKLNDSQAPK

SEQ ID NO: 214 - protein, 58 aa, ARTIFICIAL SEQUENCE
  Engineered IL-1R-I binding polypeptide
VDAKYAKETEQAQMEIFNLPNLTRRQYTAFIRKLLDDPSQSSELLSEAKKLNDSQAPK

SEQ ID NO: 215 - protein, 58 aa, ARTIFICIAL SEQUENCE
  Engineered IL-1R-I binding polypeptide
VDAKYAKEIEVAQMEIFALPNLTRKQYTAFIRKLFDDPSQSSELLSEAKKLNDSQAPK

SEQ ID NO: 216 - protein, 58 aa, ARTIFICIAL SEQUENCE
  Engineered IL-1R-I binding polypeptide
VDAKYAKEVEQAQMEIFFLPNLTRKQYTAFIRKLLDDPSQSSELLSEAKKLNDSQAPK

SEQ ID NO: 217 - protein, 58 aa, ARTIFICIAL SEQUENCE
  Engineered IL-1R-I binding polypeptide
VDAKYAKEIESAQMEIFDLPNLTRKQYTAFIRKLLDDPSQSSELLSEAKKLNDSQAPK

SEQ ID NO: 218 - protein, 58 aa, ARTIFICIAL SEQUENCE
  Engineered IL-1R-I binding polypeptide
VDAKYAKEIEKAQMEIFYLPNLTRKQYTAFIRKLLDDPSQSSELLSEAKKLNDSQAPK

SEQ ID NO: 219 - protein, 58 aa, ARTIFICIAL SEQUENCE
  Engineered IL-1R-I binding polypeptide
VDAKYAKEVEEAYMEIYYLPNLTRKQYTAFIRKLLDDPSQSSELLSEAKKLNDSQAPK

SEQ ID NO: 220 - protein, 58 aa, ARTIFICIAL SEQUENCE
  Engineered IL-1R-I binding polypeptide
VDAKYAKEVEDAQMEIYYLPNLTRKQYTAFIRKLLDDPSQSSELLSEAKKLNDSQAPK

SEQ ID NO: 221 - protein, 58 aa, ARTIFICIAL SEQUENCE
  Engineered IL-1R-I binding polypeptide
VDAKYAKEVEEAQMEIYDLPNLTRKQYTAFIRKLLDDPSQSSELLSEAKKLNDSQAPK

SEQ ID NO: 222 - protein, 58 aa, ARTIFICIAL SEQUENCE
  Engineered IL-1R-I binding polypeptide
VDAKYAKEVELAQMEIFNLPNLTRKQYTAFIRKLLDDPSQSSELLSEAKKLNDSQAPK

SEQ ID NO: 223 - protein, 58 aa, ARTIFICIAL SEQUENCE
  Engineered IL-1R-I binding polypeptide
VDAKYAKETEYAQMEIFALPNLTRKQYTAFIRKLFDDPSQSSELLSEAKKLNDSQAPK

SEQ ID NO: 224 - protein, 58 aa, ARTIFICIAL SEQUENCE
  Engineered IL-1R-I binding polypeptide
VDAKYAKEVEAAQMEIYGLPNLTRKQYTAFIRKLFDDPSQSSELLSEAKKLNDSQAPK

SEQ ID NO: 225 - protein, 58 aa, ARTIFICIAL SEQUENCE
  Engineered IL-1R-I binding polypeptide
VDAKYAKEVEVAQMEIFALPNLTRRQYTAFIRKLLDDPSQSSELLSEAKKLNDSQAPK

SEQ ID NO: 226 - protein, 58 aa, ARTIFICIAL SEQUENCE
  Engineered IL-1R-I binding polypeptide
VDAKYAKEIEFAQMEIFALPNLTRKQYTAFIRKLFDDPSQSSELLSEAKKLNDSQAPK

SEQ ID NO: 227 - protein, 58 aa, ARTIFICIAL SEQUENCE
  Engineered IL-1R-I binding polypeptide
VDAKYAKEVEEAQMEIFALPNLTRKQYTAFIRKLLDDPSQSSELLSEAKKLNDSQAPK

SEQ ID NO: 228 - protein, 58 aa, ARTIFICIAL SEQUENCE
  Engineered IL-1R-I binding polypeptide
VDAKYAKEVEEAQMEIFTLPNLTRKQYTAFIRKLLDDPSQSSELLSEAKKLNDSQAPK

SEQ ID NO: 229 - protein, 58 aa, ARTIFICIAL SEQUENCE
  Engineered IL-1R-I binding polypeptide
VDAKYAKEVEVAYMEIYNLPNLTRKQYTAFIRKLLDDPSQSSELLSEAKKLNDSQAPK

SEQ ID NO: 230 - protein, 58 aa, ARTIFICIAL SEQUENCE
  Engineered IL-1R-I binding polypeptide
VDAKYAKEVEKAQMEIYYLPNLTRKQYTAFIRKLFDDPSQSSELLSEAKKLNDSQAPK

SEQ ID NO: 231 - protein, 58 aa, ARTIFICIAL SEQUENCE
  Engineered IL-1R-I binding polypeptide
VDAKYAKEVYQAQMEIFYLPNLTRKQYTAFIRKLLDDPSQSSELLSEAKKLNDSQAPK

SEQ ID NO: 232 - protein, 58 aa, ARTIFICIAL SEQUENCE
  Engineered IL-1R-I binding polypeptide
VDAKYAKEIRDAQMEIFDLPNLTRKQYTAFIRKLFDDPSQSSELLSEAKKLNDSQAPK

SEQ ID NO: 233 - protein, 58 aa, ARTIFICIAL SEQUENCE
  Engineered IL-1R-I binding polypeptide
VDAKYAKEIEDAQLEIFALPNLTRKQYTAFIRKLLDDPSQSSELLSEAKKLNDSQAPK

SEQ ID NO: 234 - protein, 58 aa, ARTIFICIAL SEQUENCE
  Engineered IL-1R-I binding polypeptide
VDAKYAKEVEYAQMEIFALPNLTRKQYTAFIRKLLDDPSQSSELLSEAKKLNDSQAPK

SEQ ID NO: 235 - protein, 58 aa, ARTIFICIAL SEQUENCE
  Engineered IL-1R-I binding polypeptide
VDAKYAKEAYYAQMEIFALPNLTRKQYTAFIRKLLDDPSQSSELLSEAKKLNDSQAPK

SEQ ID NO: 236 - protein, 58 aa, ARTIFICIAL SEQUENCE
  Engineered IL-1R-I binding polypeptide
VDAKYAKEAEDAYMEIYELPNLTRKQYTAFIRKLLDDPSQSSELLSEAKKLNDSQAPK

SEQ ID NO: 237 - protein, 58 aa, ARTIFICIAL SEQUENCE
  Engineered IL-1R-I binding polypeptide
VDAKYAKEIEDAYMEIYRLPNLTRRQYTAFIRKLLDDPSQSSELLSEAKKLNDSQAPK

SEQ ID NO: 238 - protein, 58 aa, ARTIFICIAL SEQUENCE
  Engineered IL-1R-I binding polypeptide
VDAKYAKEVEEAQMEIFELPNLTRKQYTAFIRKLFDDPSQSSELLSEAKKLNDSQAPK

SEQ ID NO: 239 - protein, 58 aa, ARTIFICIAL SEQUENCE
  Engineered IL-1R-I binding polypeptide
VDAKYAKELEEAQMEIFALPNLTRKQYTAFIRKLLDDPSQSSELLSEAKKLNDSQAPK

SEQ ID NO: 240 - protein, 58 aa, ARTIFICIAL SEQUENCE
  Engineered IL-1R-I binding polypeptide
VDAKYAKEVETAQMEIFELPNLTRKQYTAFIRKLFDDPSQSSELLSEAKKLNDSQAPK

SEQ ID NO: 241 - protein, 58 aa, ARTIFICIAL SEQUENCE
  Engineered IL-1R-I binding polypeptide
VDAKYAKEIEDAQMEIFQLPNLTRKQYTAFIRKLLDDPSQSSELLSEAKKLNDSQAPK

SEQ ID NO: 242 - protein, 58 aa, ARTIFICIAL SEQUENCE
  Engineered IL-1R-I binding polypeptide
VDAKYAKEVEDAQMEIFELPNLTRKQYTAFIRKLFDDPSQSSELLSEAKKLNDSQAPK

SEQ ID NO: 243 - protein, 58 aa, ARTIFICIAL SEQUENCE
  Engineered IL-1R-I binding polypeptide
VDAKYAKEVEEAYMEIYHLPNLTRKQYTAFIRKLLDDPSQSSELLSEAKKLNDSQAPK

SEQ ID NO: 244 - protein, 58 aa, ARTIFICIAL SEQUENCE
  Engineered IL-1R-I binding polypeptide
VDAKYAKEVQDAQMEIFELPNLTRKQYTAFIRKLLDDPSQSSELLSEAKKLNDSQAPK

SEQ ID NO: 245 - protein, 58 aa, ARTIFICIAL SEQUENCE
  Engineered IL-1R-I binding polypeptide
VDAKYAKEIETAQMEIFALPNLTRKQYTAFIRKLFDDPSQSSELLSEAKKLNDSQAPK

SEQ ID NO: 246 - protein, 58 aa, ARTIFICIAL SEQUENCE
  Engineered IL-1R-I binding polypeptide
VDAKYAKEVEDAQMEIFGLPNLTRKQYTAFIRKLLDDPSQSSELLSEAKKLNDSQAPK

SEQ ID NO: 247 - protein, 58 aa, ARTIFICIAL SEQUENCE
  Engineered IL-1R-I binding polypeptide
VDAKYAKETEEAQMEIFRLPNLTRRQYTAFIRKLLDDPSQSSELLSEAKKLNDSQAPK

SEQ ID NO: 248 - protein, 58 aa, ARTIFICIAL SEQUENCE
  Engineered IL-1R-I binding polypeptide
VDAKYAKEVERAQMEIFNLPNLTRKQYTAFIRKLFDDPSQSSELLSEAKKLNDSQAPK

SEQ ID NO: 249 - protein, 58 aa, ARTIFICIAL SEQUENCE
  Engineered IL-1R-I binding polypeptide
VDAKYAKEAEYAQMEIFALPNLTRRQYTAFIRKLLDDPSQSSELLSEAKKLNDSQAPK

SEQ ID NO: 250 - protein, 58 aa, ARTIFICIAL SEQUENCE
  Engineered IL-1R-I binding polypeptide
VDAKYAKEIYSAQMEIFKLPNLTRKQYTAFIRKLFDDPSQSSELLSEAKKLNDSQAPK

SEQ ID NO: 251 - protein, 58 aa, ARTIFICIAL SEQUENCE
  Engineered IL-1R-I binding polypeptide
VDAKYAKEIEKAQMEIFSLPNLTRKQYTAFIRKLLDDPSQSSELLSEAKKLNDSQAPK

SEQ ID NO: 252 - protein, 58 aa, ARTIFICIAL SEQUENCE
  Engineered IL-1R-I binding polypeptide
VDAKYAKEIEEAQMEIYYLPNLTRKQYTAFIRKLFDDPSQSSELLSEAKKLNDSQAPK

SEQ ID NO: 253 - protein, 58 aa, ARTIFICIAL SEQUENCE
  Engineered IL-1R-I binding polypeptide
VDAKYAKEVEQAQMEIFSLPNLTRKQYTAFIRKLLDDPSQSSELLSEAKKLNDSQAPK

SEQ ID NO: 254 - protein, 58 aa, ARTIFICIAL SEQUENCE
  Engineered IL-1R-I binding polypeptide
VDAKYAKEVEAAQMEIFNLPNLTRRQYTAFIRKLLDDPSQSSELLSEAKKLNDSQAPK

SEQ ID NO: 255 - protein, 58 aa, ARTIFICIAL SEQUENCE
  Engineered IL-1R-I binding polypeptide
VDAKYAKEVESAQMEIFALPNLTRKQYTAFIRKLLDDPSQSSELLSEAKKLNDSQAPK

SEQ ID NO: 256 - protein, 58 aa, ARTIFICIAL SEQUENCE
  Engineered IL-1R-I binding polypeptide
VDAKYAKEIEAAQMEIFDLPNLTRKQYTAFIRKLFDDPSQSSELLSEAKKLNDSQAPK

SEQ ID NO: 257 - protein, 58 aa, ARTIFICIAL SEQUENCE
  Engineered IL-1R-I binding polypeptide
VDAKYAKETERAQMEIFALPNLTRKQYTAFIRKLLDDPSQSSELLSEAKKLNDSQAPK

SEQ ID NO: 258 - protein, 58 aa, ARTIFICIAL SEQUENCE
  Engineered IL-1R-I binding polypeptide
VDAKYAKEAEVAYFEIYALPNLTRKQYTAFIRKLLDDPSQSSELLSEAKKLNDSQAPK

SEQ ID NO: 259 - protein, 58 aa, ARTIFICIAL SEQUENCE
  Engineered IL-1R-I binding polypeptide
VDAKYAKEIEEAQMEIFGLPNLTRKQYTAFIRKLLDDPSQSSELLSEAKKLNDSQAPK

SEQ ID NO: 260 - protein, 58 aa, ARTIFICIAL SEQUENCE
  Engineered IL-1R-I binding polypeptide
VDAKYAKEVEQAQMEIFGLPNLTRKQYTAFIRKLLDDPSQSSELLSEAKKLNDSQAPK

SEQ ID NO: 261 - protein, 58 aa, ARTIFICIAL SEQUENCE
  Engineered IL-1R-I binding polypeptide
VDAKYAKEAEEAQMEIFTLPNLTRKQYTAFIRKLLDDPSQSSELLSEAKKLNDSQAPK

SEQ ID NO: 262 - protein, 58 aa, ARTIFICIAL SEQUENCE
  Engineered IL-1R-I binding polypeptide
VDAKYAKEVEEAQMEIFKLPNLTRKQYTAFIRKLLDDPSQSSELLSEAKKLNDSQAPK

SEQ ID NO: 263 - protein, 58 aa, ARTIFICIAL SEQUENCE
  Engineered IL-1R-I binding polypeptide
VDAKYAKETYYAQMEIFSLPNLTRKQYTAFIRKLLDDPSQSSELLSEAKKLNDSQAPK

SEQ ID NO: 264 - protein, 58 aa, ARTIFICIAL SEQUENCE
  Engineered IL-1R-I binding polypeptide
VDAKYAKEVEEAQMEIYSLPNLTRKQYTAFIRKLFDDPSQSSELLSEAKKLNDSQAPK

SEQ ID NO: 265 - protein, 58 aa, ARTIFICIAL SEQUENCE
  Engineered IL-1R-I binding polypeptide
VDAKYAKEIEAAQMEIFYLPNLTRKQYTAFIRKLLDDPSQSSELLSEAKKLNDSQAPK

SEQ ID NO: 266 - protein, 58 aa, ARTIFICIAL SEQUENCE
  Engineered IL-1R-I binding polypeptide
VDAKYAKEIEEAQMEIFYLPNLTRKQYTAFIRKLFDDPSQSSELLSEAKKLNDSQAPK

SEQ ID NO: 267 - protein, 58 aa, ARTIFICIAL SEQUENCE
  Engineered IL-1R-I binding polypeptide
VDAKYAKEIESAQMEIFYLPNLTRKQYTAFIRKLLDDPSQSSELLSEAKKLNDSQAPK

SEQ ID NO: 268 - protein, 58 aa, ARTIFICIAL SEQUENCE
  Engineered IL-1R-I binding polypeptide
VDAKYAKEVEEAQMEIFALPNLTRRQYTAFIRKLLDDPSQSSELLSEAKKLNDSQAPK

SEQ ID NO: 269 - protein, 58 aa, ARTIFICIAL SEQUENCE
  Engineered IL-1R-I binding polypeptide
VDAKYAKEAEEAYYEIFGLPNLTRRQYTAFIRKLLDDPSQSSELLSEAKKLNDSQAPK

SEQ ID NO: 270 - protein, 58 aa, ARTIFICIAL SEQUENCE
  Engineered IL-1R-I binding polypeptide
VDAKYAKEVEIAYFEIFGLPNLTRKQYTAFIRKLLDDPSQSSELLSEAKKLNDSQAPK

SEQ ID NO: 271 - protein, 58 aa, ARTIFICIAL SEQUENCE
  Engineered IL-1R-I binding polypeptide
VDAKYAKEVEVAQLEIFRLPNLTRKQYTAFIRKLLDDPSQSSELLSEAKKLNDSQAPK

SEQ ID NO: 272 - protein, 58 aa, ARTIFICIAL SEQUENCE
  Engineered IL-1R-I binding polypeptide
VDAKYAKEVEEAQMEIYFLPNLTRKQYTAFIRKLLDDPSQSSELLSEAKKLNDSQAPK

SEQ ID NO: 273 - protein, 58 aa, ARTIFICIAL SEQUENCE
  Engineered IL-1R-I binding polypeptide
VDAKYAKEIEEAQMEIYRLPNLTRKQYTAFIRKLFDDPSQSSELLSEAKKLNDSQAPK

SEQ ID NO: 274 - protein, 58 aa, ARTIFICIAL SEQUENCE
  Engineered IL-1R-I binding polypeptide
VDAKYAKEVRAAQMEIFELPNLTRKQYTAFIRKLLDDPSQSSELLSEAKKLNDSQAPK

SEQ ID NO: 275 - protein, 58 aa, ARTIFICIAL SEQUENCE
  Engineered IL-1R-I binding polypeptide
VDAKYAKEVEIAQMEIFELPNLTRKQYTAFIRKLLDDPSQSSELLSEAKKLNDSQAPK

SEQ ID NO: 276 - protein, 58 aa, ARTIFICIAL SEQUENCE
  Engineered IL-1R-I binding polypeptide
VDAKYAKEAERAQMEIWKLPNLTRKQYTAFIRKLFDDPSQSSELLSEAKKLNDSQAPK

SEQ ID NO: 277 - protein, 58 aa, ARTIFICIAL SEQUENCE
  Engineered IL-1R-I binding polypeptide
VDAKYAKETESAYWEIYALPNLTRKQYTAFIRKLLDDPSQSSELLSEAKKLNDSQAPK

SEQ ID NO: 278 - protein, 58 aa, ARTIFICIAL SEQUENCE
  Engineered IL-1R-I binding polypeptide
VDAKYAKEVEEAQMEIFALPNLTRKQYTAFIIKLFDDPSQSSELLSEAKKLNDSQAPK

SEQ ID NO: 279 - protein, 58 aa, ARTIFICIAL SEQUENCE
  Engineered IL-1R-I binding polypeptide
VDAKYAKELEAAQMEIYELPNLTRKQYTAFIRKLLDDPSQSSELLSEAKKLNDSQAPK

SEQ ID NO: 280 - protein, 58 aa, ARTIFICIAL SEQUENCE
  Engineered IL-1R-I binding polypeptide
VDAKYAKEVEVAQMEIFKLPNLTRKQYTAFIRKLLDDPSQSSELLSEAKKLNDSQAPK

SEQ ID NO: 281 - protein, 58 aa, ARTIFICIAL SEQUENCE
  Engineered IL-1R-I binding polypeptide
VDAKYAKEVEVAQMEIFELPNLTRKQYTAFIRKLFDDPSQSSELLSEAKKLNDSQAPK

SEQ ID NO: 282 - protein, 58 aa, ARTIFICIAL SEQUENCE
  Engineered IL-1R-I binding polypeptide
VDAKYAKEVEEAQMEIFFLPNLTRKQYTAFIIKLLDDPSQSSELLSEAKKLNDSQAPK

SEQ ID NO: 283 - protein, 58 aa, ARTIFICIAL SEQUENCE
  Engineered IL-1R-I binding polypeptide
VDAKYAKEVEAAYMEIYALPNLTRKQYTAFIRKLLDDPSQSSELLSEAKKLNDSQAPK

SEQ ID NO: 284 - protein, 58 aa, ARTIFICIAL SEQUENCE
  Engineered IL-1R-I binding polypeptide
VDAKYAKEAEYAYYEIYALPNLTRKQYTAFIRKLLDDPSQSSELLSEAKKLNDSQAPK

SEQ ID NO: 285 - protein, 58 aa, ARTIFICIAL SEQUENCE
  Engineered IL-1R-I binding polypeptide
VDAKYAKEVESAQMEIFALPNLTRKQYTAFIRKLFDDPSQSSELLSEAKKLNDSQAPK

SEQ ID NO: 286 - protein, 58 aa, ARTIFICIAL SEQUENCE
  Engineered IL-1R-I binding polypeptide
VDAKYAKELEQAQMEIFALPNLTRKQYTAFIRKLFDDPSQSSELLSEAKKLNDSQAPK

SEQ ID NO: 287 - protein, 58 aa, ARTIFICIAL SEQUENCE
  Engineered IL-1R-I binding polypeptide
VDAKYAKEIEIAQMEIFELPNLTRKQYTAFIRKLFDDPSQSSELLSEAKKLNDSQAPK

SEQ ID NO: 288 - protein, 58 aa, ARTIFICIAL SEQUENCE
  Engineered IL-1R-I binding polypeptide
VDAKYAKEVESAQMEIFALPNLTRKQYTAFIIKLFDDPSQSSELLSEAKKLNDSQAPK

SEQ ID NO: 289 - protein, 58 aa, ARTIFICIAL SEQUENCE
  Engineered IL-1R-I binding polypeptide
VDAKYAKEAENAQMEIFNLPNLTRKQYTAFIRKLLDDPSQSSELLSEAKKLNDSQAPK

SEQ ID NO: 290 - protein, 58 aa, ARTIFICIAL SEQUENCE
  Engineered IL-1R-I binding polypeptide
VDAKYAKEVTTAYYEIYNLPNLTRRQYTAFIRKLLDDPSQSSELLSEAKKLNDSQAPK

SEQ ID NO: 291 - protein, 58 aa, ARTIFICIAL SEQUENCE
  Engineered IL-1R-I binding polypeptide
VDAKYAKEIESAYYEIFALPNLTRKQYTAFIRKLLDDPSQSSELLSEAKKLNDSQAPK

SEQ ID NO: 292 - protein, 58 aa, ARTIFICIAL SEQUENCE
  Engineered IL-1R-I binding polypeptide
VDAKYAKEVEEAQMEIFYLPNLTRRQYTAFIIKLLDDPSQSSELLSEAKKLNDSQAPK

SEQ ID NO: 293 - protein, 58 aa, ARTIFICIAL SEQUENCE
  Engineered IL-1R-I binding polypeptide
VDAKYAKEIEQAQMEIYRLPNLTRKQYTAFIRKLLDDPSQSSELLSEAKKLNDSQAPK

SEQ ID NO: 294 - protein, 58 aa, ARTIFICIAL SEQUENCE
  Engineered IL-1R-I binding polypeptide
VDAKYAKETEEAQMEIFALPNLTRKQYTAFIRKLFDDPSQSSELLSEAKKLNDSQAPK

SEQ ID NO: 295 - protein, 58 aa, ARTIFICIAL SEQUENCE
  Engineered IL-1R-I binding polypeptide
VDAKYAKEVEEAQMEIFYLPNLTRRQYTAFIRKLFDDPSQSSELLSEAKKLNDSQAPK

SEQ ID NO: 296 - protein, 58 aa, ARTIFICIAL SEQUENCE
  Engineered IL-1R-I binding polypeptide
VDAKYAKEAAAAHWEIYNLPNLTRKQYTAFIRKLFDDPSQSSELLSEAKKLNDSQAPK

SEQ ID NO: 297 - protein, 58 aa, ARTIFICIAL SEQUENCE
  Engineered IL-1R-I binding polypeptide
VDAKYAKEVERAQMEIFGLPNLTRRQYTAFIIKLLDDPSQSSELLSEAKKLNDSQAPK

SEQ ID NO: 298 - protein, 58 aa, ARTIFICIAL SEQUENCE
  Engineered IL-1R-I binding polypeptide
VDAKYAKETERAQMEIFSLPNLTRKQYTAFIRKLLDDPSQSSELLSEAKKLNDSQAPK

SEQ ID NO: 299 - protein, 58 aa, ARTIFICIAL SEQUENCE
  Engineered IL-1R-I binding polypeptide
VDAKYAKEVEEAQMEIYVLPNLTRKQYTAFIRKLLDDPSQSSELLSEAKKLNDSQAPK

SEQ ID NO: 300 - protein, 58 aa, ARTIFICIAL SEQUENCE
  Engineered IL-1R-I binding polypeptide
VDAKYAKEAENAYHEIFNLPNLTRKQYTAFIRKLLDDPSQSSELLSEAKKLNDSQAPK

SEQ ID NO: 301 - protein, 58 aa, ARTIFICIAL SEQUENCE
  Engineered IL-1R-I binding polypeptide
VDAKYAKEAYAAQMEIYALPNLTRKQYTAFIRKLLDDPSQSSELLSEAKKLNDSQAPK

SEQ ID NO: 302 - protein, 58 aa, ARTIFICIAL SEQUENCE
  Engineered IL-1R-I binding polypeptide
VDAKYAKEVETAQMEIYQLPNLTRKQYTAFIRKLFDDPSQSSELLSEAKKLNDSQAPK

SEQ ID NO: 303 - protein, 58 aa, ARTIFICIAL SEQUENCE
  Engineered IL-1R-I binding polypeptide
VDAKYAKEAEDAQLEIFKLPNLTRKQYTAFIRKLLDDPSQSSELLSEAKKLNDSQAPK

SEQ ID NO: 304 - protein, 58 aa, ARTIFICIAL SEQUENCE
  Engineered IL-1R-I binding polypeptide
VDAKYAKEAQEAYYEIFALPNLTRKQYTAFIRKLLDDPSQSSELLSEAKKLNDSQAPK

SEQ ID NO: 305 - protein, 58 aa, ARTIFICIAL SEQUENCE
  Engineered IL-1R-I binding polypeptide
VDAKYAKEVEHAYMEIYSLPNLTRKQYTAFIRKLLDDPSQSSELLSEAKKLNDSQAPK

SEQ ID NO: 306 - protein, 58 aa, ARTIFICIAL SEQUENCE
  Engineered IL-1R-I binding polypeptide
VDAKYAKEVEDAQMEIFKLPNLTRKQYTAFIRKLFDDPSQSSELLSEAKKLNDSQAPK

SEQ ID NO: 307 - protein, 58 aa, ARTIFICIAL SEQUENCE
  Engineered IL-1R-I binding polypeptide
VDAKYAKEVEEAYMEIYRLPNLTRKQYTAFIRKLLDDPSQSSELLSEAKKLNDSQAPK

SEQ ID NO: 308 - protein, 58 aa, ARTIFICIAL SEQUENCE
  Engineered IL-1R-I binding polypeptide
VDAKYAKEIEYAQMEIFDLPNLTRKQYTAFIRKLFDDPSQSSELLSEAKKLNDSQAPK

SEQ ID NO: 309 - protein, 58 aa, ARTIFICIAL SEQUENCE
  Engineered IL-1R-I binding polypeptide
VDAKYAKEAEWAYMEIFALPNLTRKQYTAFIRKLLDDPSQSSELLSEAKKLNDSQAPK

SEQ ID NO: 310 - protein, 58 aa, ARTIFICIAL SEQUENCE
  Engineered IL-1R-I binding polypeptide
VDAKYAKEVEEAQYEIFNLPNLTRKQYTAFIRKLLDDPSQSSELLSEAKKLNDSQAPK

SEQ ID NO: 311 - protein, 58 aa, ARTIFICIAL SEQUENCE
  Engineered IL-1R-I binding polypeptide
VDAKYAKEIEAAQMEIFSLPNLTRKQYTAFIRKLFDDPSQSSELLSEAKKLNDSQAPK

SEQ ID NO: 312 - protein, 58 aa, ARTIFICIAL SEQUENCE
  Engineered IL-1R-I binding polypeptide
VDAKYAKEVENAYMEIFRLPNLTRKQYTAFIRKLLDDPSQSSELLSEAKKLNDSQAPK

SEQ ID NO: 313 - protein, 58 aa, ARTIFICIAL SEQUENCE
  Engineered IL-1R-I binding polypeptide
VDAKYAKEVEHAYQEIFNLPNLTRKQYTAFIRKLLDDPSQSSELLSEAKKLNDSQAPK

SEQ ID NO: 314 - protein, 58 aa, ARTIFICIAL SEQUENCE
  Engineered IL-1R-I binding polypeptide
VDAKYAKEVEDAYMEIYYLPNLTRKQYTAFIRKLLDDPSQSSELLSEAKKLNDSQAPK

SEQ ID NO: 315 - protein, 58 aa, ARTIFICIAL SEQUENCE
  Engineered IL-1R-I binding polypeptide
VDAKYAKEVEDAQMEIFGLPNLTRKQYTAFIIKLLDDPSQSSELLSEAKKLNDSQAPK

SEQ ID NO: 316 - protein, 58 aa, ARTIFICIAL SEQUENCE
  Engineered IL-1R-I binding polypeptide
VDAKYAKEVEAAQMEIFGLPNLTRKQYTAFIRKLLDDPSQSSELLSEAKKLNDSQAPK

SEQ ID NO: 317 - protein, 58 aa, ARTIFICIAL SEQUENCE
  Engineered IL-1R-I binding polypeptide
VDAKYAKEIEKAQFEIFALPNLTRKQYTAFIRKLFDDPSQSSELLSEAKKLNDSQAPK

SEQ ID NO: 318 - protein, 58 aa, ARTIFICIAL SEQUENCE
  Engineered IL-1R-I binding polypeptide
VDAKYAKEVEDAQMEIYSLPNLTRKQYTAFIRKLFDDPSQSSELLSEAKKLNDSQAPK

SEQ ID NO: 319 - protein, 58 aa, ARTIFICIAL SEQUENCE
  Engineered IL-1R-I binding polypeptide
VDAKYAKEAESAYLEIYHLPNLTRKQYTAFIRKLLDDPSQSSELLSEAKKLNDSQAPK

SEQ ID NO: 320 - protein, 58 aa, ARTIFICIAL SEQUENCE
  Engineered IL-1R-I binding polypeptide
VDAKYAKEVVEAYFEIYRLPNLTRKQYTAFIRKLLDDPSQSSELLSEAKKLNDSQAPK

SEQ ID NO: 321 - protein, 58 aa, ARTIFICIAL SEQUENCE
  Engineered IL-1R-I binding polypeptide
VDAKYAKEVEDAYFEIYNLPNLTRKQYTAFIRKLLDDPSQSSELLSEAKKLNDSQAPK

SEQ ID NO: 322 - protein, 58 aa, ARTIFICIAL SEQUENCE
  Engineered IL-1R-I binding polypeptide
VDAKYAKEAEDAYMEIYSLPNLTRRQYTAFIRKLLDDPSQSSELLSEAKKLNDSQAPK

SEQ ID NO: 323 - protein, 58 aa, ARTIFICIAL SEQUENCE
  Engineered IL-1R-I binding polypeptide
VDAKYAKEAQDAYMEIYGLPNLTRKQYTAFIRKLLDDPSQSSELLSEAKKLNDSQAPK

SEQ ID NO: 324 - protein, 58 aa, ARTIFICIAL SEQUENCE
  Engineered IL-1R-I binding polypeptide
VDAKYAKEIEAAQMEIYSLPNLTRKQYTAFIRKLLDDPSQSSELLSEAKKLNDSQAPK

SEQ ID NO: 325 - protein, 58 aa, ARTIFICIAL SEQUENCE
  Engineered IL-1R-I binding polypeptide
VDAKYAKEIEIAQMEIFGLPNLTRKQYTAFIRKLLDDPSQSSELLSEAKKLNDSQAPK

SEQ ID NO: 326 - protein, 58 aa, ARTIFICIAL SEQUENCE
  Engineered IL-1R-I binding polypeptide
VDAKYAKEVEHAQMEIFSLPNLTRKQYTAFIRKLLDDPSQSSELLSEAKKLNDSQAPK

SEQ ID NO: 327 - protein, 58 aa, ARTIFICIAL SEQUENCE
  Engineered IL-1R-I binding polypeptide
VDAKYAKEAEEAQYEIFKLPNLTRKQYTAFIRKLLDDPSQSSELLSEAKKLNDSQAPK

SEQ ID NO: 328 - protein, 58 aa, ARTIFICIAL SEQUENCE
  Engineered IL-1R-I binding polypeptide
VDAKYAKEVYHAQMEIFKLPNLTRKQYTAFIRKLFDDPSQSSELLSEAKKLNDSQAPK

SEQ ID NO: 329 - protein, 58 aa, ARTIFICIAL SEQUENCE
  Engineered IL-1R-I binding polypeptide
VDAKYAKEVEIAQLEIFALPNLTRKQYTAFIRKLLDDPSQSSELLSEAKKLNDSQAPK

SEQ ID NO: 330 - protein, 58 aa, ARTIFICIAL SEQUENCE
  Engineered IL-1R-I binding polypeptide
VDAKYAKELERAYAEIYALPNLTRKQYTAFIRKLLDDPSQSSELLSEAKKLNDSQAPK

SEQ ID NO: 331 - protein, 58 aa, ARTIFICIAL SEQUENCE
  Engineered IL-1R-I binding polypeptide
VDAKYAKEVDEAYMEIFNLPNLTRKQYTAFIRKLLDDPSQSSELLSEAKKLNDSQAPK

SEQ ID NO: 332 - protein, 58 aa, ARTIFICIAL SEQUENCE
  Engineered IL-1R-I binding polypeptide
VDAKYAKEFHRAYSEIYLLPNLTRKQYTAFIRKLFDDPSQSSELLSEAKKLNDSQAPK

SEQ ID NO: 333 - protein, 58 aa, ARTIFICIAL SEQUENCE
  Engineered IL-1R-I binding polypeptide
VDAKYAKEVELAQHEIFQLPNLTRKQYTAFIRKLFDDPSQSSELLSEAKKLNDSQAPK

SEQ ID NO: 334 - protein, 58 aa, ARTIFICIAL SEQUENCE
  Engineered IL-1R-I binding polypeptide
VDAKYAKEVESAQMEIFELPNLTRRQYTAFIRKLLDDPSQSSELLSEAKKLNDSQAPK

SEQ ID NO: 335 - protein, 58 aa, ARTIFICIAL SEQUENCE
  Engineered IL-1R-I binding polypeptide
VDAKYAKEAEIAYYEIYSLPNLTRRQYTAFIRKLLDDPSQSSELLSEAKKLNDSQAPK

SEQ ID NO: 336 - protein, 58 aa, ARTIFICIAL SEQUENCE
  Engineered IL-1R-I binding polypeptide
VDAKYAKEVEDAYFEIYGLPNLTRKQYTAFIRKLLDDPSQSSELLSEAKKLNDSQAPK

SEQ ID NO: 337 - protein, 58 aa, ARTIFICIAL SEQUENCE
  Engineered IL-1R-I binding polypeptide
VDAKYAKETFKAQQEIFALPNLTRRQYTAFIRKLLDDPSQSSELLSEAKKLNDSQAPK

SEQ ID NO: 338 - protein, 58 aa, ARTIFICIAL SEQUENCE
  Engineered IL-1R-I binding polypeptide
VDAKYAKEAEQAYWEIFSLPNLTRKQYTAFIRKLLDDPSQSSELLSEAKKLNDSQAPK

SEQ ID NO: 339 - protein, 58 aa, ARTIFICIAL SEQUENCE
  Engineered IL-1R-I binding polypeptide
VDAKYAKEVVQAYDEIYGLPNLTRKQYTAFIRKLLDDPSQSSELLSEAKKLNDSQAPK

SEQ ID NO: 340 - protein, 58 aa, ARTIFICIAL SEQUENCE
  Engineered IL-1R-I binding polypeptide
VDAKYAKEASDAYEEIYALPNLTRKQYTAFIRKLLDDPSQSSELLSEAKKLNDSQAPK

SEQ ID NO: 341 - protein, 58 aa, ARTIFICIAL SEQUENCE
  Engineered IL-1R-I binding polypeptide
VDAKYAKEIEAAQMEIFRLPNLTRKQYTAFIRKLLDDPSQSSELLSEAKKLNDSQAPK

SEQ ID NO: 342 - protein, 58 aa, ARTIFICIAL SEQUENCE
  Engineered IL-1R-I binding polypeptide
VDAKYAKEAEEAYFEIFALPNLTRKQYTAFIRKLLDDPSQSSELLSEAKKLNDSQAPK

SEQ ID NO: 343 - protein, 58 aa, ARTIFICIAL SEQUENCE
  Engineered IL-1R-I binding polypeptide
VDAKYAKEVEHAQYEIFQLPNLTRKQYTAFIRKLLDDPSQSSELLSEAKKLNDSQAPK

SEQ ID NO: 344 - protein, 58 aa, ARTIFICIAL SEQUENCE
  Engineered IL-1R-I binding polypeptide
VDAKYAKEAEKAQMEIFALPNLTRKQYTAFIRKLLDDPSQSSELLSEAKKLNDSQAPK

SEQ ID NO: 345 - protein, 58 aa, ARTIFICIAL SEQUENCE
  Engineered IL-1R-I binding polypeptide
VDAKYAKEVDAAYMEIFNLPNLTRKQYTAFIRKLLDDPSQSSELLSEAKKLNDSQAPK

SEQ ID NO: 346 - protein, 58 aa, ARTIFICIAL SEQUENCE
  Engineered IL-1R-I binding polypeptide
VDAKYAKEVEIAQMEIYNLPNLTRKQYTAFIIKLLDDPSQSSELLSEAKKLNDSQAPK

SEQ ID NO: 347 - protein, 58 aa, ARTIFICIAL SEQUENCE
  Engineered IL-1R-I binding polypeptide
VDAKYAKEVENAYFEIYQLPNLTRKQYTAFIRKLLDDPSQSSELLSEAKKLNDSQAPK

SEQ ID NO: 348 - protein, 58 aa, ARTIFICIAL SEQUENCE
  Engineered IL-1R-I binding polypeptide
VDAKYAKEVEDAYFEIYELPNLTRKQYTAFIRKLLDDPSQSSELLSEAKKLNDSQAPK

SEQ ID NO: 349 - protein, 58 aa, ARTIFICIAL SEQUENCE
  Engineered IL-1R-I binding polypeptide
VDAKYAKEVEKAYFEIYQLPNLTRKQYTAFIRKLLDDPSQSSELLSEAKKLNDSQAPK

SEQ ID NO: 350 - protein, 58 aa, ARTIFICIAL SEQUENCE
  Engineered IL-1R-I binding polypeptide
VDAKYAKEIEAAQMEIFALPNLTRKQYTAFIRKLLDDPSQSSELLSEAKKLNDSQAPK

SEQ ID NO: 351 - protein, 58 aa, ARTIFICIAL SEQUENCE
  Engineered IL-1R-I binding polypeptide
VDAKYAKETWYAQMEIFSLPNLTRKQYTAFIRKLLDDPSQSSELLSEAKKLNDSQAPK

SEQ ID NO: 352 - protein, 58 aa, ARTIFICIAL SEQUENCE
  Engineered IL-1R-I binding polypeptide
VDAKYAKEIERAQMEIFSLPNLTRKQYTAFIRKLLDDPSQSSELLSEAKKLNDSQAPK

SEQ ID NO: 353 - protein, 58 aa, ARTIFICIAL SEQUENCE
  Engineered IL-1R-I binding polypeptide
VDAKYAKEVDDAYMEIYYLPNLTRKQYTAFIRKLLDDPSQSSELLSEAKKLNDSQAPK

SEQ ID NO: 354 - protein, 58 aa, ARTIFICIAL SEQUENCE
  Engineered IL-1R-I binding polypeptide
VDAKYAKEVEAAYVEIYHLPNLTRKQYTAFIRKLLDDPSQSSELLSEAKKLNDSQAPK

SEQ ID NO: 355 - protein, 58 aa, ARTIFICIAL SEQUENCE
  Engineered IL-1R-I binding polypeptide
VDAKYAKEFSEAYFEIYSLPNLTRKQYTAFIRKLFDDPSQSSELLSEAKKLNDSQAPK

SEQ ID NO: 356 - protein, 58 aa, ARTIFICIAL SEQUENCE
  Engineered IL-1R-I binding polypeptide
VDAKYAKEVAKAQMEIFKLPNLTRKQYTAFIRKLLDDPSQSSELLSEAKKLNDSQAPK

SEQ ID NO: 357 - protein, 58 aa, ARTIFICIAL SEQUENCE
  Engineered IL-1R-I binding polypeptide
VDAKYAKEVEYAQMEIYSLPNLTRRQYTAFIRKLLDDPSQSSELLSEAKKLNDSQAPK

SEQ ID NO: 358 - protein, 58 aa, ARTIFICIAL SEQUENCE
  Engineered IL-1R-I binding polypeptide
VDAKYAKEAESAYWEIYHLPNLTRKQYTAFIRKLLDDPSQSSELLSEAKKLNDSQAPK

SEQ ID NO: 359 - protein, 58 aa, ARTIFICIAL SEQUENCE
  Engineered IL-1R-I binding polypeptide
VDAKYAKEVERAQMEIFELPNLTRRQYTAFIRKLLDDPSQSSELLSEAKKLNDSQAPK

SEQ ID NO: 360 - protein, 58 aa, ARTIFICIAL SEQUENCE
  Engineered IL-1R-I binding polypeptide
VDAKYAKEVEEAYMEIYNLPNLTRKQYTAFIRKLLDDPSQSSELLSEAKKLNDSQAPK

SEQ ID NO: 361 - protein, 58 aa, ARTIFICIAL SEQUENCE
  Engineered IL-1R-I binding polypeptide
VDAKYAKEIEVAQMEIYSLPNLTRKQYTAFIRKLFDDPSQSSELLSEAKKLNDSQAPK

SEQ ID NO: 362 - protein, 58 aa, ARTIFICIAL SEQUENCE
  Engineered IL-1R-I binding polypeptide
VDAKYAKEVRIAQFEIFALPNLTRKQYTAFIRKLFDDPSQSSELLSEAKKLNDSQAPK

SEQ ID NO: 363 - protein, 58 aa, ARTIFICIAL SEQUENCE
  Engineered IL-1R-I binding polypeptide
VDAKYAKEVEQAQHEIFNLPNLTRKQYTAFIRKLLDDPSQSSELLSEAKKLNDSQAPK

SEQ ID NO: 364 - protein, 58 aa, ARTIFICIAL SEQUENCE
  Engineered IL-1R-I binding polypeptide
VDAKYAKEAVSAYWEIFALPNLTRRQYTAFIRKLLDDPSQSSELLSEAKKLNDSQAPK

SEQ ID NO: 365 - protein, 58 aa, ARTIFICIAL SEQUENCE
  Engineered IL-1R-I binding polypeptide
VDAKYAKETEEAQMEIFYLPNLTRRQYTAFIRKLLDDPSQSSELLSEAKKLNDSQAPK

SEQ ID NO: 366 - protein, 58 aa, ARTIFICIAL SEQUENCE
  Engineered IL-1R-I binding polypeptide
VDAKYAKEADAAYMEIFGLPNLTRKQYTAFIRKLLDDPSQSSELLSEAKKLNDSQAPK

SEQ ID NO: 367 - protein, 58 aa, ARTIFICIAL SEQUENCE
  Engineered IL-1R-I binding polypeptide
VDAKYAKETAAAQAEIFNLPNLTRKQYTAFIRKLFDDPSQSSELLSEAKKLNDSQAPK

SEQ ID NO: 368 - protein, 58 aa, ARTIFICIAL SEQUENCE
  Engineered IL-1R-I binding polypeptide
VDAKYAKEAFDAYWEIYRLPNLTRKQYTAFIRKLLDDPSQSSELLSEAKKLNDSQAPK

SEQ ID NO: 369 - protein, 58 aa, ARTIFICIAL SEQUENCE
  Engineered IL-1R-I binding polypeptide
VDAKYAKEIEAAYAEIYQLPNLTRKQYTAFIRKLLDDPSQSSELLSEAKKLNDSQAPK

SEQ ID NO: 370 - protein, 58 aa, ARTIFICIAL SEQUENCE
  Engineered IL-1R-I binding polypeptide
VDAKYAKEVIDAYFEIFHLPNLTRKQYTAFIRKLLDDPSQSSELLSEAKKLNDSQAPK

SEQ ID NO: 371 - protein, 58 aa, ARTIFICIAL SEQUENCE
  Engineered IL-1R-I binding polypeptide
VDAKYAKEVESAQMEIYRLPNLTRRQYTAFIRKLLDDPSQSSELLSEAKKLNDSQAPK

SEQ ID NO: 372 - protein, 58 aa, ARTIFICIAL SEQUENCE
  Engineered IL-1R-I binding polypeptide
VDAKYAKETEEAYQEIFDLPNLTRKQYTAFIRKLLDDPSQSSELLSEAKKLNDSQAPK

SEQ ID NO: 373 - protein, 58 aa, ARTIFICIAL SEQUENCE
  Engineered IL-1R-I binding polypeptide
VDAKYAKEVEIAQMEIYSLPNLTRKQYTAFIRKLLDDPSQSSELLSEAKKLNDSQAPK

SEQ ID NO: 374 - protein, 58 aa, ARTIFICIAL SEQUENCE
  Engineered IL-1R-I binding polypeptide
VDAKYAKEVEEAQMEIFFLPNLTRKQYTAFIIKLFDDPSQSSELLSEAKKLNDSQAPK

SEQ ID NO: 375 - protein, 58 aa, ARTIFICIAL SEQUENCE
  Engineered IL-1R-I binding polypeptide
VDAKYAKEIEIAQMEIYYLPNLTRKQYTAFIRKLLDDPSQSSELLSEAKKLNDSQAPK

SEQ ID NO: 376 - protein, 58 aa, ARTIFICIAL SEQUENCE
  Engineered IL-1R-I binding polypeptide
VDAKYAKETYWAQQEIFYLPNLTRKQYTAFIRKLLDDPSQSSELLSEAKKLNDSQAPK

SEQ ID NO: 377 - protein, 58 aa, ARTIFICIAL SEQUENCE
  Engineered IL-1R-I binding polypeptide
VDAKYAKEAESAQMEIYALPNLTRKQYTAFIRKLLDDPSQSSELLSEAKKLNDSQAPK

SEQ ID NO: 378 - protein, 58 aa, ARTIFICIAL SEQUENCE
  Engineered IL-1R-I binding polypeptide
VDAKYAKELETAYFEIYELPNLTRKQYTAFIRKLLDDPSQSSELLSEAKKLNDSQAPK

SEQ ID NO: 379 - protein, 58 aa, ARTIFICIAL SEQUENCE
  Engineered IL-1R-I binding polypeptide
VDAKYAKEVEDAQMEIFYLPNLTRKQYTAFIRKLLDDPSQSSELLSEAKKLNDSQAPK

SEQ ID NO: 380 - protein, 58 aa, ARTIFICIAL SEQUENCE
  Engineered IL-1R-I binding polypeptide
VDAKYAKELELAYQEIYALPNLTRRQYTAFIRKLLDDPSQSSELLSEAKKLNDSQAPK

SEQ ID NO: 381 - protein, 58 aa, ARTIFICIAL SEQUENCE
  Engineered IL-1R-I binding polypeptide
VDAKYAKEIVAAYWEIYYLPNLTRKQYTAFIRKLLDDPSQSSELLSEAKKLNDSQAPK

SEQ ID NO: 382 - protein, 58 aa, ARTIFICIAL SEQUENCE
  Engineered IL-1R-I binding polypeptide
VDAKYAKEVEEAYMEIYALPNLTRKQYTAFIRKLLDDPSQSSELLSEAKKLNDSQAPK

SEQ ID NO: 383 - protein, 58 aa, ARTIFICIAL SEQUENCE
  Engineered IL-1R-I binding polypeptide
VDAKYAKEIDSAYFEIYALPNLTRKQYTAFIRKLLDDPSQSSELLSEAKKLNDSQAPK

SEQ ID NO: 384 - protein, 58 aa, ARTIFICIAL SEQUENCE
  Engineered IL-1R-I binding polypeptide
VDAKYAKEAEQAYQEIYELPNLTRKQYTAFIRKLLDDPSQSSELLSEAKKLNDSQAPK

SEQ ID NO: 385 - protein, 58 aa, ARTIFICIAL SEQUENCE
  Engineered IL-1R-I binding polypeptide
VDAKYAKEAYRAQMEIFELPNLTRKQYTAFIRKLLDDPSQSSELLSEAKKLNDSQAPK

SEQ ID NO: 386 - protein, 58 aa, ARTIFICIAL SEQUENCE
  Engineered IL-1R-I binding polypeptide
VDAKYAKEVEDAYFEIYALPNLTRKQYTAFIRKLLDDPSQSSELLSEAKKLNDSQAPK

SEQ ID NO: 387 - protein, 58 aa, ARTIFICIAL SEQUENCE
  Engineered IL-1R-I binding polypeptide
VDAKYAKEIEAAQMEIFYLPNLTRKQYTAFIRKLFDDPSQSSELLSEAKKLNDSQAPK

SEQ ID NO: 388 - protein, 58 aa, ARTIFICIAL SEQUENCE
  Engineered IL-1R-I binding polypeptide
VDAKYAKEAYEAQMEIFELPNLTRKQYTAFIRKLLDDPSQSSELLSEAKKLNDSQAPK

SEQ ID NO: 389 - protein, 58 aa, ARTIFICIAL SEQUENCE
  Engineered IL-1R-I binding polypeptide
VDAKYAKEVVDAYFEIYELPNLTRKQYTAFIRKLLDDPSQSSELLSEAKKLNDSQAPK

SEQ ID NO: 390 - protein, 58 aa, ARTIFICIAL SEQUENCE
  Engineered IL-1R-I binding polypeptide
VDAKYAKEVEQAQMEIFKLPNLTRKQYTAFIRKLFDDPSQSSELLSEAKKLNDSQAPK

SEQ ID NO: 391 - protein, 58 aa, ARTIFICIAL SEQUENCE
  Engineered IL-1R-I binding polypeptide
VDAKYAKETEKAQMEIFELPNLTRKQYTAFIRKLLDDPSQSSELLSEAKKLNDSQAPK

SEQ ID NO: 392 - protein, 58 aa, ARTIFICIAL SEQUENCE
  Engineered IL-1R-I binding polypeptide
VDAKYAKETYQAQMEIFGLPNLTRRQYTAFIRKLLDDPSQSSELLSEAKKLNDSQAPK

SEQ ID NO: 393 - protein, 58 aa, ARTIFICIAL SEQUENCE
  Engineered IL-1R-I binding polypeptide
VDAKYAKEVESAQMEIFALPNLTRKQYTAFIIKLLDDPSQSSELLSEAKKLNDSQAPK

SEQ ID NO: 394 - protein, 58 aa, ARTIFICIAL SEQUENCE
  Engineered IL-1R-I binding polypeptide
VDAKYAKEIEDAQMEIFGLPNLTRRQYTAFIRKLLDDPSQSSELLSEAKKLNDSQAPK

SEQ ID NO: 395 - protein, 58 aa, ARTIFICIAL SEQUENCE
  Engineered IL-1R-I binding polypeptide
VDAKYAKEVEKAQLEIFALPNLTRKQYTAFIRKLFDDPSQSSELLSEAKKLNDSQAPK

SEQ ID NO: 396 - protein, 58 aa, ARTIFICIAL SEQUENCE
  Engineered IL-1R-I binding polypeptide
VDAKYAKEIEQAQFEIFYLPNLTRKQYTAFIRKLLDDPSQSSELLSEAKKLNDSQAPK

SEQ ID NO: 397 - protein, 58 aa, ARTIFICIAL SEQUENCE
  Engineered IL-1R-I binding polypeptide
VDAKYAKETEVAQMEIFKLPNLTRKQYTAFIIKLFDDPSQSSELLSEAKKLNDSQAPK

SEQ ID NO: 398 - protein, 58 aa, ARTIFICIAL SEQUENCE
  Engineered IL-1R-I binding polypeptide
VDAKYAKEVEQAQMEIFELPNLTRKQYTAFIRKLLDDPSQSSELLSEAKKLNDSQAPK

SEQ ID NO: 399 - protein, 58 aa, ARTIFICIAL SEQUENCE
  Engineered IL-1R-I binding polypeptide
VDAKYAKEVEIAQHEIFELPNLTRKQYTAFIRKLLDDPSQSSELLSEAKKLNDSQAPK

SEQ ID NO: 400 - protein, 58 aa, ARTIFICIAL SEQUENCE
  Engineered IL-1R-I binding polypeptide
VDAKYAKEVELAYMEIYKLPNLTRKQYTAFIRKLLDDPSQSSELLSEAKKLNDSQAPK

SEQ ID NO: 401 - protein, 58 aa, ARTIFICIAL SEQUENCE
  Engineered IL-1R-I binding polypeptide
VDAKYAKEVVQAYDEIFQLPNLTRKQYTAFIRKLLDDPSQSSELLSEAKKLNDSQAPK

SEQ ID NO: 402 - protein, 58 aa, ARTIFICIAL SEQUENCE
  Engineered IL-1R-I binding polypeptide
VDAKYAKEVEEAQMEIFNLPNLTRKQYTAFIRKLFDDPSQSSELLSEAKKLNDSQAPK

SEQ ID NO: 403 - protein, 58 aa, ARTIFICIAL SEQUENCE
  Engineered IL-1R-I binding polypeptide
VDAKYAKEVEEAQMEIYNLPNLTRKQYTAFIRKLLDDPSQSSELLSEAKKLNDSQAPK

SEQ ID NO: 404 - protein, 58 aa, ARTIFICIAL SEQUENCE
  Engineered IL-1R-I binding polypeptide
VDAKYAKEVEKAQMEIFDLPNLTRKQYTAFIRKLFDDPSQSSELLSEAKKLNDSQAPK

SEQ ID NO: 405 - protein, 58 aa, ARTIFICIAL SEQUENCE
  Engineered IL-1R-I binding polypeptide
VDAKYAKEVEEAYWEIYALPNLTRKQYTAFIRKLLDDPSQSSELLSEAKKLNDSQAPK

SEQ ID NO: 406 - protein, 58 aa, ARTIFICIAL SEQUENCE
  Engineered IL-1R-I binding polypeptide
VDAKYAKEAETAYHEIYILPNLTRKQYTAFIRKLLDDPSQSSELLSEAKKLNDSQAPK

SEQ ID NO: 407 - protein, 58 aa, ARTIFICIAL SEQUENCE
  Engineered IL-1R-I binding polypeptide
VDAKYAKEAEEAQMEIYNLPNLTRKQYTAFIRKLLDDPSQSSELLSEAKKLNDSQAPK

SEQ ID NO: 408 - protein, 58 aa, ARTIFICIAL SEQUENCE
  Engineered IL-1R-I binding polypeptide
VDAKYAKEVEFAYFEIYALPNLTRKQYTAFIRKLLDDPSQSSELLSEAKKLNDSQAPK

SEQ ID NO: 409 - protein, 58 aa, ARTIFICIAL SEQUENCE
  Engineered IL-1R-I binding polypeptide
VDAKYAKEARQAYWEIYSLPNLTRKQYTAFIRKLLDDPSQSSELLSEAKKLNDSQAPK

SEQ ID NO: 410 - protein, 58 aa, ARTIFICIAL SEQUENCE
  Engineered IL-1R-I binding polypeptide
VDAKYAKETETAQLEIFALPNLTRKQYTAFIRKLLDDPSQSSELLSEAKKLNDSQAPK

SEQ ID NO: 411 - protein, 58 aa, ARTIFICIAL SEQUENCE
  Engineered IL-1R-I binding polypeptide
VDAKYAKEIEEAQHEIFRLPNLTRKQYTAFIRKLFDDPSQSSELLSEAKKLNDSQAPK

SEQ ID NO: 412 - protein, 58 aa, ARTIFICIAL SEQUENCE
  Engineered IL-1R-I binding polypeptide
VDAKYAKEVSNAYMEIYKLPNLTRKQYTAFIRKLLDDPSQSSELLSEAKKLNDSQAPK

SEQ ID NO: 413 - protein, 58 aa, ARTIFICIAL SEQUENCE
  Engineered IL-1R-I binding polypeptide
VDAKYAKEIEEAQMEIYELPNLTRKQYTAFIRKLLDDPSQSSELLSEAKKLNDSQAPK

SEQ ID NO: 414 - protein, 58 aa, ARTIFICIAL SEQUENCE
  Engineered IL-1R-I binding polypeptide
VDAKYAKEVTDAQMEIFALPNLTRKQYTAFIRKLLDDPSQSSELLSEAKKLNDSQAPK

SEQ ID NO: 415 - protein, 58 aa, ARTIFICIAL SEQUENCE
  Engineered IL-1R-I binding polypeptide
VDAKYAKEIEHAQLEIFSLPNLTRKQYTAFIRKLLDDPSQSSELLSEAKKLNDSQAPK

SEQ ID NO: 416 - protein, 58 aa, ARTIFICIAL SEQUENCE
  Engineered IL-1R-I binding polypeptide
VDAKYAKEVEQAQMEIFNLPNLTRKQYTAFIRKLLDDPSQSSELLSEAKKLNDSQAPK

SEQ ID NO: 417 - protein, 58 aa, ARTIFICIAL SEQUENCE
  Engineered IL-1R-I binding polypeptide
VDAKYAKEAEWAQMEIFSLPNLTRKQYTAFIRKLLDDPSQSSELLSEAKKLNDSQAPK

SEQ ID NO: 418 - protein, 58 aa, ARTIFICIAL SEQUENCE
  Engineered IL-1R-I binding polypeptide
VDAKYAKEVHAAQMEIFELPNLTRKQYTAFIRKLLDDPSQSSELLSEAKKLNDSQAPK

SEQ ID NO: 419 - protein, 58 aa, ARTIFICIAL SEQUENCE
  Engineered IL-1R-I binding polypeptide
VDAKYAKEVEFAQMEIYYLPNLTRKQYTAFIRKLLDDPSQSSELLSEAKKLNDSQAPK

SEQ ID NO: 420 - protein, 58 aa, ARTIFICIAL SEQUENCE
  Engineered IL-1R-I binding polypeptide
VDAKYAKEVIDAYFEIYELPNLTRKQYTAFIRKLLDDPSQSSELLSEAKKLNDSQAPK

SEQ ID NO: 421 - protein, 58 aa, ARTIFICIAL SEQUENCE
  Engineered IL-1R-I binding polypeptide
VDAKYAKEVEDAYMEIYDLPNLTRKQYTAFIRKLLDDPSQSSELLSEAKKLNDSQAPK

SEQ ID NO: 422 - protein, 58 aa, ARTIFICIAL SEQUENCE
  Engineered IL-1R-I binding polypeptide
VDAKYAKEVEAAQLEIFALPNLTRKQYTAFIRKLFDDPSQSSELLSEAKKLNDSQAPK

SEQ ID NO: 423 - protein, 58 aa, ARTIFICIAL SEQUENCE
  Engineered IL-1R-I binding polypeptide
VDAKYAKETVAAYWEIYALPNLTRKQYTAFIRKLLDDPSQSSELLSEAKKLNDSQAPK

SEQ ID NO: 424 - protein, 58 aa, ARTIFICIAL SEQUENCE
  Engineered IL-1R-I binding polypeptide
VDAKYAKEVVDAYWEIYALPNLTRKQYTAFIRKLLDDPSQSSELLSEAKKLNDSQAPK

SEQ ID NO: 425 - protein, 58 aa, ARTIFICIAL SEQUENCE
  Engineered IL-1R-I binding polypeptide
VDAKYAKETEEAYWEIYGLPNLTRKQYTAFIRKLLDDPSQSSELLSEAKKLNDSQAPK

SEQ ID NO: 426 - protein, 58 aa, ARTIFICIAL SEQUENCE
  Engineered IL-1R-I binding polypeptide
VDAKYAKEVETAYFEIYHLPNLTRKQYTAFIRKLLDDPSQSSELLSEAKKLNDSQAPK

SEQ ID NO: 427 - protein, 58 aa, ARTIFICIAL SEQUENCE
  Engineered IL-1R-I binding polypeptide
VDAKYAKEVVDAYYEIYELPNLTRKQYTAFIRKLLDDPSQSSELLSEAKKLNDSQAPK

SEQ ID NO: 428 - protein, 58 aa, ARTIFICIAL SEQUENCE
  Engineered IL-1R-I binding polypeptide
VDAKYAKEVQEAYMEIFQLPNLTRKQYTAFIRKLLDDPSQSSELLSEAKKLNDSQAPK

SEQ ID NO: 429 - protein, 58 aa, ARTIFICIAL SEQUENCE
  Engineered IL-1R-I binding polypeptide
VDAKYAKEVEDAYYEIYSLPNLTRKQYTAFIRKLLDDPSQSSELLSEAKKLNDSQAPK

SEQ ID NO: 430 - protein, 58 aa, ARTIFICIAL SEQUENCE
  Engineered IL-1R-I binding polypeptide
VDAKYAKEVVEAYDEIFRLPNLTRKQYTAFIRKLLDDPSQSSELLSEAKKLNDSQAPK

SEQ ID NO: 431 - protein, 58 aa, ARTIFICIAL SEQUENCE
  Engineered IL-1R-I binding polypeptide
VDAKYAKETEEAQMEIFNLPNLTRKQYTAFIRKLLDDPSQSSELLSEAKKLNDSQAPK

SEQ ID NO: 432 - protein, 58 aa, ARTIFICIAL SEQUENCE
  Engineered IL-1R-I binding polypeptide
VDAKYAKEVIDAYDEIYDLPNLTRKQYTAFIRKLLDDPSQSSELLSEAKKLNDSQAPK

SEQ ID NO: 433 - protein, 58 aa, ARTIFICIAL SEQUENCE
  Engineered IL-1R-I binding polypeptide
VDAKYAKEVVDAYYEIYALPNLTRKQYTAFIRKLLDDPSQSSELLSEAKKLNDSQAPK

SEQ ID NO: 434 - protein, 58 aa, ARTIFICIAL SEQUENCE
  Engineered IL-1R-I binding polypeptide
VDAKYAKEVEEAYFEIYHLPNLTRKQYTAFIRKLLDDPSQSSELLSEAKKLNDSQAPK

SEQ ID NO: 435 - protein, 58 aa, ARTIFICIAL SEQUENCE
  Engineered IL-1R-I binding polypeptide
VDAKYAKEVESAYMEIFALPNLTRKQYTAFIRKLLDDPSQSSELLSEAKKLNDSQAPK

SEQ ID NO: 436 - protein, 58 aa, ARTIFICIAL SEQUENCE
  Engineered IL-1R-I binding polypeptide
VDAKYAKEVEDAYWEIYALPNLTRKQYTAFIRKLLDDPSQSSELLSEAKKLNDSQAPK

SEQ ID NO: 437 - protein, 58 aa, ARTIFICIAL SEQUENCE
  Engineered IL-1R-I binding polypeptide
VDAKYAKEAESAYFEIYALPNLTRKQYTAFIRKLLDDPSQSSELLSEAKKLNDSQAPK

SEQ ID NO: 438 - protein, 58 aa, ARTIFICIAL SEQUENCE
  Engineered IL-1R-I binding polypeptide
VDAKYAKEVEEAYMEIYQLPNLTRKQYTAFIRKLLDDPSQSSELLSEAKKLNDSQAPK

SEQ ID NO: 439 - protein, 58 aa, ARTIFICIAL SEQUENCE
  Engineered IL-1R-I binding polypeptide
VDAKYAKEVEHAYFEIYKLPNLTRKQYTAFIRKLLDDPSQSSELLSEAKKLNDSQAPK

SEQ ID NO: 440 - protein, 58 aa, ARTIFICIAL SEQUENCE
  Engineered IL-1R-I binding polypeptide
VDAKYAKEVETAYFEIFALPNLTRKQYTAFIRKLLDDPSQSSELLSEAKKLNDSQAPK

SEQ ID NO: 441 - protein, 58 aa, ARTIFICIAL SEQUENCE
  Engineered IL-1R-I binding polypeptide
VDAKYAKEVEDAYMEIFKLPNLTRKQYTAFIRKLLDDPSQSSELLSEAKKLNDSQAPK

SEQ ID NO: 442 - protein, 58 aa, ARTIFICIAL SEQUENCE
  Engineered IL-1R-I binding polypeptide
VDAKYAKEAHDAYWEIYSLPNLTRKQYTAFIRKLLDDPSQSSELLSEAKKLNDSQAPK

SEQ ID NO: 443 - protein, 58 aa, ARTIFICIAL SEQUENCE
  Engineered IL-1R-I binding polypeptide
VDAKYAKEVEDAYMEIYRLPNLTRKQYTAFIRKLLDDPSQSSELLSEAKKLNDSQAPK

SEQ ID NO: 444 - protein, 58 aa, ARTIFICIAL SEQUENCE
  Engineered IL-1R-I binding polypeptide
VDAKYAKEVEEAYEEIYQLPNLTRKQYTAFIRKLLDDPSQSSELLSEAKKLNDSQAPK

SEQ ID NO: 445 - protein, 58 aa, ARTIFICIAL SEQUENCE
  Engineered IL-1R-I binding polypeptide
VDAKYAKEVEIAYMEIYQLPNLTRKQYTAFIRKLLDDPSQSSELLSEAKKLNDSQAPK

SEQ ID NO: 446 - protein, 58 aa, ARTIFICIAL SEQUENCE
  Engineered IL-1R-I binding polypeptide
VDAKYAKEVEQAYFEIYGLPNLTRKQYTAFIRKLLDDPSQSSELLSEAKKLNDSQAPK

SEQ ID NO: 447 - protein, 58 aa, ARTIFICIAL SEQUENCE
  Engineered IL-1R-I binding polypeptide
VDAKYAKEVEEAYMEIYELPNLTRKQYTAFIRKLLDDPSQSSELLSEAKKLNDSQAPK

SEQ ID NO: 448 - protein, 58 aa, ARTIFICIAL SEQUENCE
  Engineered IL-1R-I binding polypeptide
VDAKYAKEVEEAYYEIYLLPNLTRKQYTAFIRKLLDDPSQSSELLSEAKKLNDSQAPK

SEQ ID NO: 449 - protein, 58 aa, ARTIFICIAL SEQUENCE
  Engineered IL-1R-I binding polypeptide
VDAKYAKETEDAYMEIYALPNLTRKQYTAFIRKLLDDPSQSSELLSEAKKLNDSQAPK

SEQ ID NO: 450 - protein, 58 aa, ARTIFICIAL SEQUENCE
  Engineered IL-1R-I binding polypeptide
VDAKYAKEVEHAYFEIFGLPNLTRKQYTAFIRKLLDDPSQSSELLSEAKKLNDSQAPK

SEQ ID NO: 451 - protein, 58 aa, ARTIFICIAL SEQUENCE
  Engineered IL-1R-I binding polypeptide
VDAKYAKEVEEAYFEIYELPNLTRKQYTAFIRKLLDDPSQSSELLSEAKKLNDSQAPK

SEQ ID NO: 452 - protein, 58 aa, ARTIFICIAL SEQUENCE
  Engineered IL-1R-I binding polypeptide
VDAKYAKEVETAYMEIFYLPNLTRKQYTAFIRKLLDDPSQSSELLSEAKKLNDSQAPK

SEQ ID NO: 453 - protein, 58 aa, ARTIFICIAL SEQUENCE
  Engineered IL-1R-I binding polypeptide
VDAKYAKEVEDAYMEIYHLPNLTRKQYTAFIRKLLDDPSQSSELLSEAKKLNDSQAPK

SEQ ID NO: 454 - protein, 58 aa, ARTIFICIAL SEQUENCE
  Engineered IL-1R-I binding polypeptide
VDAKYAKEIEEAYMEIYQLPNLTRKQYTAFIRKLLDDPSQSSELLSEAKKLNDSQAPK

SEQ ID NO: 455 - protein, 58 aa, ARTIFICIAL SEQUENCE
  Engineered IL-1R-I binding polypeptide
VDAKYAKEVEDAYFEIYTLPNLTRKQYTAFIRKLLDDPSQSSELLSEAKKLNDSQAPK

SEQ ID NO: 456 - protein, 58 aa, ARTIFICIAL SEQUENCE
  Engineered IL-1R-I binding polypeptide
VDAKYAKEVEEAYFEIFKLPNLTRKQYTAFIRKLLDDPSQSSELLSEAKKLNDSQAPK

SEQ ID NO: 457 - protein, 58 aa, ARTIFICIAL SEQUENCE
  Engineered IL-1R-I binding polypeptide
VDAKYAKEAEKAYWEIYALPNLTRKQYTAFIRKLLDDPSQSSELLSEAKKLNDSQAPK

SEQ ID NO: 458 - protein, 58 aa, ARTIFICIAL SEQUENCE
  Engineered IL-1R-I binding polypeptide
VDAKYAKEVEVAYFEIFALPNLTRKQYTAFIRKLLDDPSQSSELLSEAKKLNDSQAPK

SEQ ID NO: 459 - protein, 58 aa, ARTIFICIAL SEQUENCE
  Engineered IL-1R-I binding polypeptide
VDAKYAKEVEEAYFEIFELPNLTRKQYTAFIRKLLDDPSQSSELLSEAKKLNDSQAPK

SEQ ID NO: 460 - protein, 58 aa, ARTIFICIAL SEQUENCE
  Engineered IL-1R-I binding polypeptide
VDAKYAKEVTDAYMEIFHLPNLTRKQYTAFIRKLLDDPSQSSELLSEAKKLNDSQAPK

SEQ ID NO: 461 - protein, 58 aa, ARTIFICIAL SEQUENCE
  Engineered IL-1R-I binding polypeptide
VDAKYAKEVEVAYWEIFELPNLTRKQYTAFIRKLLDDPSQSSELLSEAKKLNDSQAPK

SEQ ID NO: 462 - protein, 58 aa, ARTIFICIAL SEQUENCE
  Engineered IL-1R-I binding polypeptide
VDAKYAKEVEYAYFEIYELPNLTRKQYTAFIRKLLDDPSQSSELLSEAKKLNDSQAPK

SEQ ID NO: 463 - protein, 58 aa, ARTIFICIAL SEQUENCE
  Engineered IL-1R-I binding polypeptide
VDAKYAKEVEAAYMEIFYLPNLTRKQYTAFIRKLLDDPSQSSELLSEAKKLNDSQAPK

SEQ ID NO: 464 - protein, 58 aa, ARTIFICIAL SEQUENCE
  Engineered IL-1R-I binding polypeptide
VDAKYAKEVEDAYWEIFHLPNLTRKQYTAFIRKLLDDPSQSSELLSEAKKLNDSQAPK

SEQ ID NO: 465 - protein, 58 aa, ARTIFICIAL SEQUENCE
  Engineered IL-1R-I binding polypeptide
VDAKYAKEVVDAYYEIFELPNLTRKQYTAFIRKLLDDPSQSSELLSEAKKLNDSQAPK

SEQ ID NO: 466 - protein, 58 aa, ARTIFICIAL SEQUENCE
  Engineered IL-1R-I binding polypeptide
VDAKYAKEATAAYMEIYFLPNLTRKQYTAFIRKLLDDPSQSSELLSEAKKLNDSQAPK

SEQ ID NO: 467 - protein, 58 aa, ARTIFICIAL SEQUENCE
  Engineered IL-1R-I binding polypeptide
VDAKYAKEASDAYQEIYALPNLTRKQYTAFIRKLLDDPSQSSELLSEAKKLNDSQAPK

SEQ ID NO: 468 - protein, 58 aa, ARTIFICIAL SEQUENCE
  Engineered IL-1R-I binding polypeptide
VDAKYAKEAQTAYWEIYKLPNLTRKQYTAFIRKLLDDPSQSSELLSEAKKLNDSQAPK

SEQ ID NO: 469 - protein, 58 aa, ARTIFICIAL SEQUENCE
  Engineered IL-1R-I binding polypeptide
VDAKYAKETVDAYWEIYALPNLTRKQYTAFIRKLLDDPSQSSELLSEAKKLNDSQAPK

SEQ ID NO: 470 - protein, 58 aa, ARTIFICIAL SEQUENCE
  Engineered IL-1R-I binding polypeptide
VDAKYAKEVEDAYYEIYELPNLTRKQYTAFIRKLLDDPSQSSELLSEAKKLNDSQAPK

SEQ ID NO: 471 - protein, 58 aa, ARTIFICIAL SEQUENCE
  Engineered IL-1R-I binding polypeptide
VDAKYAKEVVEAYWEIYSLPNLTRKQYTAFIRKLLDDPSQSSELLSEAKKLNDSQAPK

SEQ ID NO: 472 - protein, 58 aa, ARTIFICIAL SEQUENCE
  Engineered IL-1R-I binding polypeptide
VDAKYAKEADEAYWEIYSLPNLTRKQYTAFIRKLLDDPSQSSELLSEAKKLNDSQAPK

SEQ ID NO: 473 - protein, 58 aa, ARTIFICIAL SEQUENCE
  Engineered IL-1R-I binding polypeptide
VDAKYAKEVEFAYFEIYNLPNLTRKQYTAFIRKLLDDPSQSSELLSEAKKLNDSQAPK

SEQ ID NO: 474 - protein, 58 aa, ARTIFICIAL SEQUENCE
  Engineered IL-1R-I binding polypeptide
VDAKYAKEVVDAYYEIYNLPNLTRKQYTAFIRKLLDDPSQSSELLSEAKKLNDSQAPK

SEQ ID NO: 475 - protein, 58 aa, ARTIFICIAL SEQUENCE
  Engineered IL-1R-I binding polypeptide
VDAKYAKEVEAAYFEIFSLPNLTRKQYTAFIRKLLDDPSQSSELLSEAKKLNDSQAPK

SEQ ID NO: 476 - protein, 58 aa, ARTIFICIAL SEQUENCE
  Engineered IL-1R-I binding polypeptide
VDAKYAKEVEDAYMEIFQLPNLTRKQYTAFIRKLLDDPSQSSELLSEAKKLNDSQAPK

SEQ ID NO: 477 - protein, 58 aa, ARTIFICIAL SEQUENCE
  Engineered IL-1R-I binding polypeptide
VDAKYAKEAELAYWEIYKLPNLTRKQYTAFIRKLLDDPSQSSELLSEAKKLNDSQAPK

SEQ ID NO: 478 - protein, 58 aa, ARTIFICIAL SEQUENCE
  Engineered IL-1R-I binding polypeptide
VDAKYAKEVEKAYMEIYYLPNLTRKQYTAFIRKLLDDPSQSSELLSEAKKLNDSQAPK

SEQ ID NO: 479 - protein, 58 aa, ARTIFICIAL SEQUENCE
  Engineered IL-1R-I binding polypeptide
VDAKYAKEQEFAYFEIYKLPNLTRKQYTAFIRKLLDDPSQSSELLSEAKKLNDSQAPK

SEQ ID NO: 480 - protein, 58 aa, ARTIFICIAL SEQUENCE
  Engineered IL-1R-I binding polypeptide
VDAKYAKELDAAYMEIYGLPNLTRRQYTAFIRKLLDDPSQSSELLSEAKKLNDSQAPK

SEQ ID NO: 481 - protein, 58 aa, ARTIFICIAL SEQUENCE
  Engineered IL-1R-I binding polypeptide
VDAKYAKEAEQAYYEIYELPNLTRKQYTAFIRKLLDDPSQSSELLSEAKKLNDSQAPK

SEQ ID NO: 482 - protein, 58 aa, ARTIFICIAL SEQUENCE
  Engineered IL-1R-I binding polypeptide
VDAKYAKEHVEAYFEIFSLPNLTRKQYTAFIRKLLDDPSQSSELLSEAKKLNDSQAPK

SEQ ID NO: 483 - protein, 58 aa, ARTIFICIAL SEQUENCE
  Engineered IL-1R-I binding polypeptide
VDAKYAKEVTAAYYEIFALPNLTRKQYTAFIRKLLDDPSQSSELLSEAKKLNDSQAPK

SEQ ID NO: 484 - protein, 58 aa, ARTIFICIAL SEQUENCE
  Engineered IL-1R-I binding polypeptide
VDAKYAKEVEIAYFEIYNLPNLTRRQYTAFIRKLLDDPSQSSELLSEAKKLNDSQAPK

SEQ ID NO: 485 - protein, 58 aa, ARTIFICIAL SEQUENCE
  Engineered IL-1R-I binding polypeptide
VDAKYAKEAQDAYFEIYELPNLTRKQYTAFIRKLLDDPSQSSELLSEAKKLNDSQAPK

SEQ ID NO: 486 - protein, 58 aa, ARTIFICIAL SEQUENCE
  Engineered IL-1R-I binding polypeptide
VDAKYAKEVITAYWEIFALPNLTRKQYTAFIRKLLDDPSQSSELLSEAKKLNDSQAPK

SEQ ID NO: 487 - protein, 58 aa, ARTIFICIAL SEQUENCE
  Engineered IL-1R-I binding polypeptide
VDAKYAKEVENAQMEIFALPNLTRKQYTAFIRKLLDDPSQSSELLSEAKKLNDSQAPK

SEQ ID NO: 488 - protein, 58 aa, ARTIFICIAL SEQUENCE
  Engineered IL-1R-I binding polypeptide
VDAKYAKEHVDAYWEIYALPNLTRKQYTAFIRKLLDDPSQSSELLSEAKKLNDSQAPK

SEQ ID NO: 489 - protein, 58 aa, ARTIFICIAL SEQUENCE
  Engineered IL-1R-I binding polypeptide
VDAKYAKEVTNAYFEIYDLPNLTRKQYTAFIRKLLDDPSQSSELLSEAKKLNDSQAPK

SEQ ID NO: 490 - protein, 58 aa, ARTIFICIAL SEQUENCE
  Engineered IL-1R-I binding polypeptide
VDAKYAKEAAEAQMEIFNLPNLTRKQYTAFIRKLLDDPSQSSELLSEAKKLNDSQAPK

SEQ ID NO: 491 - protein, 58 aa, ARTIFICIAL SEQUENCE
  Engineered IL-1R-I binding polypeptide
VDAKYAKEVHEAYFEIYDLPNLTRKQYTAFIRKLLDDPSQSSELLSEAKKLNDSQAPK

SEQ ID NO: 492 - protein, 58 aa, ARTIFICIAL SEQUENCE
  Engineered IL-1R-I binding polypeptide
VDAKYAKEADIAYWEIYALPNLTRKQYTAFIRKLLDDPSQSSELLSEAKKLNDSQAPK

SEQ ID NO: 493 - protein, 58 aa, ARTIFICIAL SEQUENCE
  Engineered IL-1R-I binding polypeptide
VDAKYAKEVEVAYMEIYRLPNLTRKQYTAFIRKLLDDPSQSSELLSEAKKLNDSQAPK

SEQ ID NO: 494 - protein, 58 aa, ARTIFICIAL SEQUENCE
  Engineered IL-1R-I binding polypeptide
VDAKYAKEIEAAQMEIFELPNLTRKQYTAFIRKLLDDPSQSSELLSEAKKLNDSQAPK

SEQ ID NO: 495 - protein, 58 aa, ARTIFICIAL SEQUENCE
  Engineered IL-1R-I binding polypeptide
VDAKYAKEVETAYFEIYNLPNLTRKQYTAFIRKLLDDPSQSSELLSEAKKLNDSQAPK

SEQ ID NO: 496 - protein, 58 aa, ARTIFICIAL SEQUENCE
  Engineered IL-1R-I binding polypeptide
VDAKYAKEAQQAYWEIFALPNLTRKQYTAFIRKLLDDPSQSSELLSEAKKLNDSQAPK

SEQ ID NO: 497 - protein, 58 aa, ARTIFICIAL SEQUENCE
  Engineered IL-1R-I binding polypeptide
VDAKYAKEIDKAYFEIFELPNLTRKQYTAFIRKLLDDPSQSSELLSEAKKLNDSQAPK

SEQ ID NO: 498 - protein, 58 aa, ARTIFICIAL SEQUENCE
  Engineered IL-1R-I binding polypeptide
VDAKYAKEVESAYFEIYSLPNLTRKQYTAFIRKLLDDPSQSSELLSEAKKLNDSQAPK

SEQ ID NO: 499 - protein, 58 aa, ARTIFICIAL SEQUENCE
  Engineered IL-1R-I binding polypeptide
VDAKYAKELYLAYFEIYALPNLTRKQYTAFIRKLLDDPSQSSELLSEAKKLNDSQAPK

SEQ ID NO: 500 - protein, 58 aa, ARTIFICIAL SEQUENCE
  Engineered IL-1R-I binding polypeptide
VDAKYAKEAVEAYFEIYELPNLTRKQYTAFIRKLLDDPSQSSELLSEAKKLNDSQAPK

SEQ ID NO: 501 - protein, 58 aa, ARTIFICIAL SEQUENCE
  Engineered IL-1R-I binding polypeptide
VDAKYAKEAVNAYWEIFALPNLTRRQYTAFIRKLLDDPSQSSELLSEAKKLNDSQAPK

SEQ ID NO: 502 - protein, 58 aa, ARTIFICIAL SEQUENCE
  Engineered IL-1R-I binding polypeptide
VDAKYAKELEYAYFEIYKLPNLTRKQYTAFIRKLLDDPSQSSELLSEAKKLNDSQAPK

SEQ ID NO: 503 - protein, 58 aa, ARTIFICIAL SEQUENCE
  Engineered IL-1R-I binding polypeptide
VDAKYAKEVQAAYWEIFALPNLTRKQYTAFIRKLLDDPSQSSELLSEAKKLNDSQAPK

SEQ ID NO: 504 - protein, 58 aa, ARTIFICIAL SEQUENCE
  Engineered IL-1R-I binding polypeptide
VDAKYAKEVEKAQMEIFDLPNLTRKQYTAFIRKLLDDPSQSSELLSEAKKLNDSQAPK

SEQ ID NO: 505 - protein, 58 aa, ARTIFICIAL SEQUENCE
  Engineered IL-1R-I binding polypeptide
VDAKYAKETYAAQMEIFSLPNLTRKQYTAFIRKLLDDPSQSSELLSEAKKLNDSQAPK

SEQ ID NO: 506 - protein, 58 aa, ARTIFICIAL SEQUENCE
  Engineered IL-1R-I binding polypeptide
VDAKYAKELEAAYYEIYELPNLTRKQYTAFIRKLLDDPSQSSELLSEAKKLNDSQAPK

SEQ ID NO: 507 - protein, 58 aa, ARTIFICIAL SEQUENCE
  Engineered IL-1R-I binding polypeptide
VDAKYAKEHVDAYFEIYALPNLTRKQYTAFIRKLLDDPSQSSELLSEAKKLNDSQAPK

SEQ ID NO: 508 - protein, 58 aa, ARTIFICIAL SEQUENCE
  Engineered IL-1R-I binding polypeptide
VDAKYAKETIHAYDEIYGLPNLTRKQYTAFIRKLLDDPSQSSELLSEAKKLNDSQAPK

SEQ ID NO: 509 - protein, 58 aa, ARTIFICIAL SEQUENCE
  Engineered IL-1R-I binding polypeptide
VDAKYAKEQEEAYWEIFQLPNLTRKQYTAFIRKLLDDPSQSSELLSEAKKLNDSQAPK

SEQ ID NO: 510 - protein, 58 aa, ARTIFICIAL SEQUENCE
  Engineered IL-1R-I binding polypeptide
VDAKYAKEVEEAYYEIYALPNLTRKQYTAFIRKLLDDPSQSSELLSEAKKLNDSQAPK

SEQ ID NO: 511 - protein, 58 aa, ARTIFICIAL SEQUENCE
  Engineered IL-1R-I binding polypeptide
VDAKYAKEIEEAQMEIFSLPNLTRKQYTAFIRKLFDDPSQSSELLSEAKKLNDSQAPK

SEQ ID NO: 512 - protein, 58 aa, ARTIFICIAL SEQUENCE
  Engineered IL-1R-I binding polypeptide
VDAKYAKEVEDAYFEIYDLPNLTRKQYTAFIRKLLDDPSQSSELLSEAKKLNDSQAPK

SEQ ID NO: 513 - protein, 58 aa, ARTIFICIAL SEQUENCE
  Engineered IL-1R-I binding polypeptide
VDAKYAKEIEEAQMEIYTLPNLTRKQYTAFIRKLLDDPSQSSELLSEAKKLNDSQAPK

SEQ ID NO: 514 - protein, 58 aa, ARTIFICIAL SEQUENCE
  Engineered IL-1R-I binding polypeptide
VDAKYAKEVERAYFEIYDLPNLTRKQYTAFIRKLLDDPSQSSELLSEAKKLNDSQAPK

SEQ ID NO: 515 - protein, 58 aa, ARTIFICIAL SEQUENCE
  Engineered IL-1R-I binding polypeptide
VDAKYAKEVVIAYHEIFKLPNLTRKQYTAFIRKLLDDPSQSSELLSEAKKLNDSQAPK

SEQ ID NO: 516 - protein, 58 aa, ARTIFICIAL SEQUENCE
  Engineered IL-1R-I binding polypeptide
VDAKYAKEAYDAQMEIFGLPNLTRKQYTAFIRKLLDDPSQSSELLSEAKKLNDSQAPK

SEQ ID NO: 517 - protein, 58 aa, ARTIFICIAL SEQUENCE
  Engineered IL-1R-I binding polypeptide
VDAKYAKEIIQAYYEIYHLPNLTRKQYTAFIRKLLDDPSQSSELLSEAKKLNDSQAPK

SEQ ID NO: 518 - protein, 58 aa, ARTIFICIAL SEQUENCE
  Engineered IL-1R-I binding polypeptide
VDAKYAKEVVSAYFEIYQLPNLTRKQYTAFIRKLLDDPSQSSELLSEAKKLNDSQAPK

SEQ ID NO: 519 - protein, 58 aa, ARTIFICIAL SEQUENCE
  Engineered IL-1R-I binding polypeptide
VDAKYAKEVEDAYFEIYKLPNLTRKQYTAFIRKLLDDPSQSSELLSEAKKLNDSQAPK

SEQ ID NO: 520 - protein, 58 aa, ARTIFICIAL SEQUENCE
  Engineered IL-1R-I binding polypeptide
VDAKYAKEVVEAYHEIFELPNLTRKQYTAFIRKLLDDPSQSSELLSEAKKLNDSQAPK

SEQ ID NO: 521 - protein, 58 aa, ARTIFICIAL SEQUENCE
  Engineered IL-1R-I binding polypeptide
VDAKYAKEAEVAYYEIYSLPNLTRKQYTAFIRKLLDDPSQSSELLSEAKKLNDSQAPK

SEQ ID NO: 522 - protein, 58 aa, ARTIFICIAL SEQUENCE
  Engineered IL-1R-I binding polypeptide
VDAKYAKEVEEAYMEIFGLPNLTRKQYTAFIRKLLDDPSQSSELLSEAKKLNDSQAPK

SEQ ID NO: 523 - protein, 58 aa, ARTIFICIAL SEQUENCE
  Engineered IL-1R-I binding polypeptide
VDAKYAKEAEWAYFEIFKLPNLTRKQYTAFIRKLLDDPSQSSELLSEAKKLNDSQAPK

SEQ ID NO: 524 - protein, 58 aa, ARTIFICIAL SEQUENCE
  Engineered IL-1R-I binding polypeptide
VDAKYAKEAEAAYWEIYALPNLTRKQYTAFIRKLLDDPSQSSELLSEAKKLNDSQAPK

SEQ ID NO: 525 - protein, 58 aa, ARTIFICIAL SEQUENCE
  Engineered IL-1R-I binding polypeptide
VDAKYAKEAYVAYYEIYNLPNLTRKQYTAFIRKLLDDPSQSSELLSEAKKLNDSQAPK

SEQ ID NO: 526 - protein, 58 aa, ARTIFICIAL SEQUENCE
  Engineered IL-1R-I binding polypeptide
VDAKYAKELEYAYHEIFALPNLTRKQYTAFIRKLLDDPSQSSELLSEAKKLNDSQAPK

SEQ ID NO: 527 - protein, 58 aa, ARTIFICIAL SEQUENCE
  Engineered IL-1R-I binding polypeptide
VDAKYAKESESAYWEIYALPNLTRKQYTAFIRKLLDDPSQSSELLSEAKKLNDSQAPK

SEQ ID NO: 528 - protein, 58 aa, ARTIFICIAL SEQUENCE
  Engineered IL-1R-I binding polypeptide
VDAKYAKEVEEAYQEIFNLPNLTRKQYTAFIRKLLDDPSQSSELLSEAKKLNDSQAPK

SEQ ID NO: 529 - protein, 58 aa, ARTIFICIAL SEQUENCE
  Engineered IL-1R-I binding polypeptide
VDAKYAKEIEEAYMEIFNLPNLTRKQYTAFIRKLLDDPSQSSELLSEAKKLNDSQAPK

SEQ ID NO: 530 - protein, 58 aa, ARTIFICIAL SEQUENCE
  Engineered IL-1R-I binding polypeptide
VDAKYAKEVVDAYSEIYLLPNLTRKQYTAFIRKLLDDPSQSSELLSEAKKLNDSQAPK

SEQ ID NO: 531 - protein, 58 aa, ARTIFICIAL SEQUENCE
  Engineered IL-1R-I binding polypeptide
VDAKYAKELEAAQMEIFALPNLTRRQYTAFIRKLLDDPSQSSELLSEAKKLNDSQAPK

SEQ ID NO: 532 - protein, 58 aa, ARTIFICIAL SEQUENCE
  Engineered IL-1R-I binding polypeptide
VDAKYAKEVEVAYMEIFELPNLTRKQYTAFIRKLLDDPSQSSELLSEAKKLNDSQAPK

SEQ ID NO: 533 - protein, 58 aa, ARTIFICIAL SEQUENCE
  Engineered IL-1R-I binding polypeptide
VDAKYAKEVHEAYFEIFALPNLTRKQYTAFIRKLLDDPSQSSELLSEAKKLNDSQAPK

SEQ ID NO: 534 - protein, 58 aa, ARTIFICIAL SEQUENCE
  Engineered IL-1R-I binding polypeptide
VDAKYAKEVENAYYEIYELPNLTRKQYTAFIRKLLDDPSQSSELLSEAKKLNDSQAPK

SEQ ID NO: 535 - protein, 58 aa, ARTIFICIAL SEQUENCE
  Engineered IL-1R-I binding polypeptide
VDAKYAKEVEHAYYEIYRLPNLTRKQYTAFIRKLLDDPSQSSELLSEAKKLNDSQAPK

SEQ ID NO: 536 - protein, 58 aa, ARTIFICIAL SEQUENCE
  Engineered IL-1R-I binding polypeptide
VDAKYAKEAEDAYMEIFHLPNLTRKQYTAFIRKLLDDPSQSSELLSEAKKLNDSQAPK

SEQ ID NO: 537 - protein, 58 aa, ARTIFICIAL SEQUENCE
  Engineered IL-1R-I binding polypeptide
VDAKYAKETYAAQMEIYRLPNLTRKQYTAFIRKLLDDPSQSSELLSEAKKLNDSQAPK

SEQ ID NO: 538 - protein, 58 aa, ARTIFICIAL SEQUENCE
  Engineered IL-1R-I binding polypeptide
VDAKYAKEAEYAYFEIFALPNLTRKQYTAFIRKLLDDPSQSSELLSEAKKLNDSQAPK

SEQ ID NO: 539 - protein, 58 aa, ARTIFICIAL SEQUENCE
  Engineered IL-1R-I binding polypeptide
VDAKYAKEVVEAYYEIYELPNLTRKQYTAFIRKLLDDPSQSSELLSEAKKLNDSQAPK

SEQ ID NO: 540 - protein, 58 aa, ARTIFICIAL SEQUENCE
  Engineered IL-1R-I binding polypeptide
VDAKYAKEVVHAYFEIFSLPNLTRKQYTAFIRKLLDDPSQSSELLSEAKKLNDSQAPK

SEQ ID NO: 541 - protein, 58 aa, ARTIFICIAL SEQUENCE
  Engineered IL-1R-I binding polypeptide
VDAKYAKEIENAQMEIFYLPNLTRRQYTAFIRKLLDDPSQSSELLSEAKKLNDSQAPK

SEQ ID NO: 542 - protein, 58 aa, ARTIFICIAL SEQUENCE
  Engineered IL-1R-I binding polypeptide
VDAKYAKEVEAAYFEIYTLPNLTRKQYTAFIRKLLDDPSQSSELLSEAKKLNDSQAPK

SEQ ID NO: 543 - protein, 58 aa, ARTIFICIAL SEQUENCE
  Engineered IL-1R-I binding polypeptide
VDAKYAKETLHAYDEIYQLPNLTRKQYTAFIRKLLDDPSQSSELLSEAKKLNDSQAPK

SEQ ID NO: 544 - protein, 58 aa, ARTIFICIAL SEQUENCE
  Engineered IL-1R-I binding polypeptide
VDAKYAKEVEEAYMEIFRLPNLTRKQYTAFIRKLLDDPSQSSELLSEAKKLNDSQAPK

SEQ ID NO: 545 - protein, 58 aa, ARTIFICIAL SEQUENCE
  Engineered IL-1R-I binding polypeptide
VDAKYAKEVEEAQMEIFNLPNLTRKQYTAFIRKLLDDPSQSSELLSEAKKLNDSQAPK

SEQ ID NO: 546 - protein, 58 aa, ARTIFICIAL SEQUENCE
  Engineered IL-1R-I binding polypeptide
VDAKYAKETVDAYYEIYALPNLTRKQYTAFIRKLLDDPSQSSELLSEAKKLNDSQAPK

SEQ ID NO: 547 - protein, 58 aa, ARTIFICIAL SEQUENCE
  Engineered IL-1R-I binding polypeptide
VDAKYAKEAEEAYFEIYGLPNLTRKQYTAFIRKLLDDPSQSSELLSEAKKLNDSQAPK

SEQ ID NO: 548 - protein, 58 aa, ARTIFICIAL SEQUENCE
  Engineered IL-1R-I binding polypeptide
VDAKYAKEIEIAQMEIFTLPNLTRKQYTAFIRKLLDDPSQSSELLSEAKKLNDSQAPK

SEQ ID NO: 549 - protein, 58 aa, ARTIFICIAL SEQUENCE
  Engineered IL-1R-I binding polypeptide
VDAKYAKEVEIAYFEIFALPNLTRKQYTAFIRKLLDDPSQSSELLSEAKKLNDSQAPK

SEQ ID NO: 550 - protein, 58 aa, ARTIFICIAL SEQUENCE
  Engineered IL-1R-I binding polypeptide
VDAKYAKEVEQAQMEIFRLPNLTRKQYTAFIRKLLDDPSQSSELLSEAKKLNDSQAPK

SEQ ID NO: 551 - protein, 58 aa, ARTIFICIAL SEQUENCE
  Engineered IL-1R-I binding polypeptide
VDAKYAKEVQDAYWEIYQLPNLTRKQYTAFIRKLLDDPSQSSELLSEAKKLNDSQAPK

SEQ ID NO: 552 - protein, 58 aa, ARTIFICIAL SEQUENCE
  Engineered IL-1R-I binding polypeptide
VDAKYAKETEEAYWEIYALPNLTRKQYTAFIRKLLDDPSQSSELLSEAKKLNDSQAPK

SEQ ID NO: 553 - protein, 58 aa, ARTIFICIAL SEQUENCE
  Engineered IL-1R-I binding polypeptide
VDAKYAKEVEAAYFEIYALPNLTRKQYTAFIRKLLDDPSQSSELLSEAKKLNDSQAPK

SEQ ID NO: 554 - protein, 58 aa, ARTIFICIAL SEQUENCE
  Engineered IL-1R-I binding polypeptide
VDAKYAKEIEDAQMEIFGLPNLTRKQYTAFIRKLLDDPSQSSELLSEAKKLNDSQAPK

SEQ ID NO: 555 - protein, 58 aa, ARTIFICIAL SEQUENCE
  Engineered IL-1R-I binding polypeptide
VDAKYAKEVEVAYFEIFHLPNLTRKQYTAFIRKLLDDPSQSSELLSEAKKLNDSQAPK

SEQ ID NO: 556 - protein, 58 aa, ARTIFICIAL SEQUENCE
  Engineered IL-1R-I binding polypeptide
VDAKYAKEIETAYMEIYRLPNLTRKQYTAFIRKLLDDPSQSSELLSEAKKLNDSQAPK

SEQ ID NO: 557 - protein, 58 aa, ARTIFICIAL SEQUENCE
  Engineered IL-1R-I binding polypeptide
VDAKYAKEADAAYWEIYALPNLTRKQYTAFIRKLLDDPSQSSELLSEAKKLNDSQAPK

SEQ ID NO: 558 - protein, 58 aa, ARTIFICIAL SEQUENCE
  Engineered IL-1R-I binding polypeptide
VDAKYAKEVEQAYYEIYHLPNLTRKQYTAFIRKLLDDPSQSSELLSEAKKLNDSQAPK

SEQ ID NO: 559 - protein, 58 aa, ARTIFICIAL SEQUENCE
  Engineered IL-1R-I binding polypeptide
VDAKYAKEIEKAYYEIYELPNLTRKQYTAFIRKLLDDPSQSSELLSEAKKLNDSQAPK

SEQ ID NO: 560 - protein, 58 aa, ARTIFICIAL SEQUENCE
  Engineered IL-1R-I binding polypeptide
VDAKYAKEVVAAYYEIYGLPNLTRKQYTAFIRKLLDDPSQSSELLSEAKKLNDSQAPK

SEQ ID NO: 561 - protein, 58 aa, ARTIFICIAL SEQUENCE
  Engineered IL-1R-I binding polypeptide
VDAKYAKEVVSAYYEIYNLPNLTRKQYTAFIRKLLDDPSQSSELLSEAKKLNDSQAPK

SEQ ID NO: 562 - protein, 58 aa, ARTIFICIAL SEQUENCE
  Engineered IL-1R-I binding polypeptide
VDAKYAKETERAQMEIFYLPNLTRKQYTAFIRKLLDDPSQSSELLSEAKKLNDSQAPK

SEQ ID NO: 563 - protein, 58 aa, ARTIFICIAL SEQUENCE
  Engineered IL-1R-I binding polypeptide
VDAKYAKEVESAYFEIFKLPNLTRKQYTAFIRKLLDDPSQSSELLSEAKKLNDSQAPK

SEQ ID NO: 564 - protein, 58 aa, ARTIFICIAL SEQUENCE
  Engineered IL-1R-I binding polypeptide
VDAKYAKEVEKAYMEIYALPNLTRKQYTAFIRKLLDDPSQSSELLSEAKKLNDSQAPK

SEQ ID NO: 565 - protein, 58 aa, ARTIFICIAL SEQUENCE
  Engineered IL-1R-I binding polypeptide
VDAKYAKETEDAYMEIYELPNLTRKQYTAFIRKLLDDPSQSSELLSEAKKLNDSQAPK

SEQ ID NO: 566 - protein, 58 aa, ARTIFICIAL SEQUENCE
  Engineered IL-1R-I binding polypeptide
VDAKYAKEAEEAYFEIYNLPNLTRKQYTAFIRKLLDDPSQSSELLSEAKKLNDSQAPK

SEQ ID NO: 567 - protein, 58 aa, ARTIFICIAL SEQUENCE
  Engineered IL-1R-I binding polypeptide
VDAKYAKETLEAYDEIYQLPNLTRKQYTAFIRKLLDDPSQSSELLSEAKKLNDSQAPK

SEQ ID NO: 568 - protein, 58 aa, ARTIFICIAL SEQUENCE
  Engineered IL-1R-I binding polypeptide
VDAKYAKELEVAYMEIFHLPNLTRKQYTAFIRKLLDDPSQSSELLSEAKKLNDSQAPK

SEQ ID NO: 569 - protein, 58 aa, ARTIFICIAL SEQUENCE
  Engineered IL-1R-I binding polypeptide
VDAKYAKEVEIAQMEIFGLPNLTRKQYTAFIRKLLDDPSQSSELLSEAKKLNDSQAPK

SEQ ID NO: 570 - protein, 58 aa, ARTIFICIAL SEQUENCE
  Engineered IL-1R-I binding polypeptide
VDAKYAKEVVEAYQEIFHLPNLTRKQYTAFIRKLLDDPSQSSELLSEAKKLNDSQAPK

SEQ ID NO: 571 - protein, 58 aa, ARTIFICIAL SEQUENCE
  Engineered IL-1R-I binding polypeptide
VDAKYAKEAEEAYYEIYGLPNLTRKQYTAFIRKLLDDPSQSSELLSEAKKLNDSQAPK

SEQ ID NO: 572 - protein, 58 aa, ARTIFICIAL SEQUENCE
  Engineered IL-1R-I binding polypeptide
VDAKYAKEVEAAYMEIFHLPNLTRKQYTAFIRKLLDDPSQSSELLSEAKKLNDSQAPK

SEQ ID NO: 573 - protein, 58 aa, ARTIFICIAL SEQUENCE
  Engineered IL-1R-I binding polypeptide
VDAKYAKEHEDAYMEIYALPNLTRKQYTAFIRKLLDDPSQSSELLSEAKKLNDSQAPK

SEQ ID NO: 574 - protein, 58 aa, ARTIFICIAL SEQUENCE
  Engineered IL-1R-I binding polypeptide
VDAKYAKELEKAYFEIYNLPNLTRKQYTAFIRKLLDDPSQSSELLSEAKKLNDSQAPK

SEQ ID NO: 575 - protein, 58 aa, ARTIFICIAL SEQUENCE
  Engineered IL-1R-I binding polypeptide
VDAKYAKEVEIAQMEIFALPNLTRRQYTAFIRKLLDDPSQSSELLSEAKKLNDSQAPK

SEQ ID NO: 576 - protein, 58 aa, ARTIFICIAL SEQUENCE
  Engineered IL-1R-I binding polypeptide
VDAKYAKEVELAYMEIFNLPNLTRRQYTAFIRKLLDDPSQSSELLSEAKKLNDSQAPK

SEQ ID NO: 577 - protein, 58 aa, ARTIFICIAL SEQUENCE
  Engineered IL-1R-I binding polypeptide
VDAKYAKEVFEAQMEIYRLPNLTRKQYTAFIRKLLDDPSQSSELLSEAKKLNDSQAPK

SEQ ID NO: 578 - protein, 58 aa, ARTIFICIAL SEQUENCE
  Engineered IL-1R-I binding polypeptide
VDAKYAKEVEDAYMEIYELPNLTRKQYTAFIRKLLDDPSQSSELLSEAKKLNDSQAPK

SEQ ID NO: 579 - protein, 58 aa, ARTIFICIAL SEQUENCE
  Engineered IL-1R-I binding polypeptide
VDAKYAKETESAYFEIFKLPNLTRKQYTAFIRKLLDDPSQSSELLSEAKKLNDSQAPK

SEQ ID NO: 580 - protein, 58 aa, ARTIFICIAL SEQUENCE
  Engineered IL-1R-I binding polypeptide
VDAKYAKELEEAYFEIYELPNLTRKQYTAFIRKLLDDPSQSSELLSEAKKLNDSQAPK

SEQ ID NO: 581 - protein, 58 aa, ARTIFICIAL SEQUENCE
  Engineered IL-1R-I binding polypeptide
VDAKYAKEVVTAYQEIYELPNLTRKQYTAFIRKLLDDPSQSSELLSEAKKLNDSQAPK

SEQ ID NO: 582 - protein, 58 aa, ARTIFICIAL SEQUENCE
  Engineered IL-1R-I binding polypeptide
VDAKYAKEVEAAYFEIYELPNLTRKQYTAFIRKLLDDPSQSSELLSEAKKLNDSQAPK

SEQ ID NO: 583 - protein, 58 aa, ARTIFICIAL SEQUENCE
  Engineered IL-1R-I binding polypeptide
VDAKYAKEVEWAYMEIYHLPNLTRKQYTAFIRKLLDDPSQSSELLSEAKKLNDSQAPK

SEQ ID NO: 584 - protein, 58 aa, ARTIFICIAL SEQUENCE
  Engineered IL-1R-I binding polypeptide
VDAKYAKETEYAYWEIYALPNLTRKQYTAFIRKLLDDPSQSSELLSEAKKLNDSQAPK

SEQ ID NO: 585 - protein, 58 aa, ARTIFICIAL SEQUENCE
  Engineered IL-1R-I binding polypeptide
VDAKYAKEVETAYMEIYNLPNLTRKQYTAFIRKLLDDPSQSSELLSEAKKLNDSQAPK

SEQ ID NO: 586 - protein, 58 aa, ARTIFICIAL SEQUENCE
  Engineered IL-1R-I binding polypeptide
VDAKYAKEVEFAYMEIYNLPNLTRKQYTAFIRKLLDDPSQSSELLSEAKKLNDSQAPK

SEQ ID NO: 587 - protein, 58 aa, ARTIFICIAL SEQUENCE
  Engineered IL-1R-I binding polypeptide
VDAKYAKEVEAAYFEIFALPNLTRKQYTAFIRKLLDDPSQSSELLSEAKKLNDSQAPK

SEQ ID NO: 588 - protein, 58 aa, ARTIFICIAL SEQUENCE
  Engineered IL-1R-I binding polypeptide
VDAKYAKEVERAYMEIFHLPNLTRKQYTAFIRKLLDDPSQSSELLSEAKKLNDSQAPK

SEQ ID NO: 589 - protein, 58 aa, ARTIFICIAL SEQUENCE
  Engineered IL-1R-I binding polypeptide
VDAKYAKETVIAYFEIFKLPNLTRKQYTAFIRKLLDDPSQSSELLSEAKKLNDSQAPK

SEQ ID NO: 590 - protein, 58 aa, ARTIFICIAL SEQUENCE
  Engineered IL-1R-I binding polypeptide
VDAKYAKETEDAYFEIYHLPNLTRKQYTAFIRKLLDDPSQSSELLSEAKKLNDSQAPK

SEQ ID NO: 591 - protein, 58 aa, ARTIFICIAL SEQUENCE
  Engineered IL-1R-I binding polypeptide
VDAKYAKEADSAYWEIYALPNLTRKQYTAFIRKLLDDPSQSSELLSEAKKLNDSQAPK

SEQ ID NO: 592 - protein, 58 aa, ARTIFICIAL SEQUENCE
  Engineered IL-1R-I binding polypeptide
VDAKYAKEVELAQMEIFALPNLTRKQYTAFIRKLLDDPSQSSELLSEAKKLNDSQAPK

SEQ ID NO: 593 - protein, 58 aa, ARTIFICIAL SEQUENCE
  Engineered IL-1R-I binding polypeptide
VDAKYAKEVEQAYFEIYDLPNLTRKQYTAFIRKLLDDPSQSSELLSEAKKLNDSQAPK

SEQ ID NO: 594 - protein, 58 aa, ARTIFICIAL SEQUENCE
  Engineered IL-1R-I binding polypeptide
VDAKYAKEAVDAYYEIYHLPNLTRKQYTAFIRKLLDDPSQSSELLSEAKKLNDSQAPK

SEQ ID NO: 595 - protein, 58 aa, ARTIFICIAL SEQUENCE
  Engineered IL-1R-I binding polypeptide
VDAKYAKELQEAYMEIYHLPNLTRKQYTAFIRKLLDDPSQSSELLSEAKKLNDSQAPK

SEQ ID NO: 596 - protein, 58 aa, ARTIFICIAL SEQUENCE
  Engineered IL-1R-I binding polypeptide
VDAKYAKEHVDAYMEIYALPNLTRKQYTAFIRKLLDDPSQSSELLSEAKKLNDSQAPK

SEQ ID NO: 597 - protein, 58 aa, ARTIFICIAL SEQUENCE
  Engineered IL-1R-I binding polypeptide
VDAKYAKEVEHAYEEIYALPNLTRRQYTAFIRKLLDDPSQSSELLSEAKKLNDSQAPK

SEQ ID NO: 598 - protein, 58 aa, ARTIFICIAL SEQUENCE
  Engineered IL-1R-I binding polypeptide
VDAKYAKEVVVAYHEIFALPNLTRKQYTAFIRKLLDDPSQSSELLSEAKKLNDSQAPK

SEQ ID NO: 599 - protein, 58 aa, ARTIFICIAL SEQUENCE
  Engineered IL-1R-I binding polypeptide
VDAKYAKEHWKAYLEIYALPNLTRKQYTAFIRKLLDDPSQSSELLSEAKKLNDSQAPK

SEQ ID NO: 600 - protein, 58 aa, ARTIFICIAL SEQUENCE
  Engineered IL-1R-I binding polypeptide
VDAKYAKEVYDAQMEIFALPNLTRKQYTAFIRKLLDDPSQSSELLSEAKKLNDSQAPK

SEQ ID NO: 601 - protein, 58 aa, ARTIFICIAL SEQUENCE
  Engineered IL-1R-I binding polypeptide
VDAKYAKEVEAAYMEIYGLPNLTRKQYTAFIRKLLDDPSQSSELLSEAKKLNDSQAPK

SEQ ID NO: 602 - protein, 58 aa, ARTIFICIAL SEQUENCE
  Engineered IL-1R-I binding polypeptide
VDAKYAKEHLTAYYEIYALPNLTRKQYTAFIRKLLDDPSQSSELLSEAKKLNDSQAPK

SEQ ID NO: 603 - protein, 58 aa, ARTIFICIAL SEQUENCE
  Engineered IL-1R-I binding polypeptide
VDAKYAKEVKDAYFEIFELPNLTRKQYTAFIRKLLDDPSQSSELLSEAKKLNDSQAPK

SEQ ID NO: 604 - protein, 58 aa, ARTIFICIAL SEQUENCE
  Engineered IL-1R-I binding polypeptide
VDAKYAKETEYAQMEIFALPNLTRKQYTAFIRKLLDDPSQSSELLSEAKKLNDSQAPK

SEQ ID NO: 605 - protein, 58 aa, ARTIFICIAL SEQUENCE
  Engineered IL-1R-I binding polypeptide
VDAKYAKEIEDAYMEIYHLPNLTRKQYTAFIRKLLDDPSQSSELLSEAKKLNDSQAPK

SEQ ID NO: 606 - protein, 58 aa, ARTIFICIAL SEQUENCE
  Engineered IL-1R-I binding polypeptide
VDAKYAKELEEAYYEIYDLPNLTRKQYTAFIRKLLDDPSQSSELLSEAKKLNDSQAPK

SEQ ID NO: 607 - protein, 58 aa, ARTIFICIAL SEQUENCE
  Engineered IL-1R-I binding polypeptide
VDAKYAKETENAYMEIYHLPNLTRKQYTAFIRKLLDDPSQSSELLSEAKKLNDSQAPK

SEQ ID NO: 608 - protein, 58 aa, ARTIFICIAL SEQUENCE
  Engineered IL-1R-I binding polypeptide
VDAKYAKEIESAYFEIYELPNLTRKQYTAFIRKLLDDPSQSSELLSEAKKLNDSQAPK

SEQ ID NO: 609 - protein, 58 aa, ARTIFICIAL SEQUENCE
  Engineered IL-1R-I binding polypeptide
VDAKYAKEVYIAQMEIFRLPNLTRKQYTAFIRKLLDDPSQSSELLSEAKKLNDSQAPK

SEQ ID NO: 610 - protein, 58 aa, ARTIFICIAL SEQUENCE
  Engineered IL-1R-I binding polypeptide
VDAKYAKEVEEAYFEIFALPNLTRRQYTAFIRKLLDDPSQSSELLSEAKKLNDSQAPK

SEQ ID NO: 611 - protein, 58 aa, ARTIFICIAL SEQUENCE
  Engineered IL-1R-I binding polypeptide
VDAKYAKEAINAHHEIFLLPNLTRKQYTAFIRKLFDDPSQSSELLSEAKKLNDSQAPK

SEQ ID NO: 612 - protein, 58 aa, ARTIFICIAL SEQUENCE
  Engineered IL-1R-I binding polypeptide
VDAKYAKEIEDAQMEIYRLPNLTRKQYTAFIRKLLDDPSQSSELLSEAKKLNDSQAPK

SEQ ID NO: 613 - protein, 58 aa, ARTIFICIAL SEQUENCE
  Engineered IL-1R-I binding polypeptide
VDAKYAKEAYEAQMEIFSLPNLTRKQYTAFIRKLLDDPSQSSELLSEAKKLNDSQAPK

SEQ ID NO: 614 - protein, 58 aa, ARTIFICIAL SEQUENCE
  Engineered IL-1R-I binding polypeptide
VDAKYAKEAEDAYMEIYHLPNLTRKQYTAFIRKLLDDPSQSSELLSEAKKLNDSQAPK

SEQ ID NO: 615 - protein, 58 aa, ARTIFICIAL SEQUENCE
  Engineered IL-1R-I binding polypeptide
VDAKYAKEVEQAYFEIYSLPNLTRKQYTAFIRKLLDDPSQSSELLSEAKKLNDSQAPK

SEQ ID NO: 616 - protein, 58 aa, ARTIFICIAL SEQUENCE
  Engineered IL-1R-I binding polypeptide
VDAKYAKEIEEAQMEIYFLPNLTRKQYTAFIRKLLDDPSQSSELLSEAKKLNDSQAPK

SEQ ID NO: 617 - protein, 58 aa, ARTIFICIAL SEQUENCE
  Engineered IL-1R-I binding polypeptide
VDAKYAKETVSAYFEIYNLPNLTRKQYTAFIRKLLDDPSQSSELLSEAKKLNDSQAPK

SEQ ID NO: 618 - protein, 58 aa, ARTIFICIAL SEQUENCE
  Engineered IL-1R-I binding polypeptide
VDAKYAKETEEAYFEIYNLPNLTRKQYTAFIRKLLDDPSQSSELLSEAKKLNDSQAPK

SEQ ID NO: 619 - protein, 58 aa, ARTIFICIAL SEQUENCE
  Engineered IL-1R-I binding polypeptide
VDAKYAKEADRAYWEIYALPNLTRKQYTAFIRKLLDDPSQSSELLSEAKKLNDSQAPK

SEQ ID NO: 620 - protein, 58 aa, ARTIFICIAL SEQUENCE
  Engineered IL-1R-I binding polypeptide
VDAKYAKETYKAQQEIYKLPNLTRRQYTAFIRKLLDDPSQSSELLSEAKKLNDSQAPK

SEQ ID NO: 621 - protein, 58 aa, ARTIFICIAL SEQUENCE
  Engineered IL-1R-I binding polypeptide
VDAKYAKEVEVAYWEIFNLPNLTRKQYTAFIRKLLDDPSQSSELLSEAKKLNDSQAPK

SEQ ID NO: 622 - protein, 58 aa, ARTIFICIAL SEQUENCE
  Engineered IL-1R-I binding polypeptide
VDAKYAKELERAYYEIYDLPNLTRKQYTAFIRKLLDDPSQSSELLSEAKKLNDSQAPK

SEQ ID NO: 623 - protein, 58 aa, ARTIFICIAL SEQUENCE
  Engineered IL-1R-I binding polypeptide
VDAKYAKEAIDAYWEIYHLPNLTRKQYTAFIRKLLDDPSQSSELLSEAKKLNDSQAPK

SEQ ID NO: 624 - protein, 58 aa, ARTIFICIAL SEQUENCE
  Engineered IL-1R-I binding polypeptide
VDAKYAKEVESAYMEIFHLPNLTRKQYTAFIRKLLDDPSQSSELLSEAKKLNDSQAPK

SEQ ID NO: 625 - protein, 58 aa, ARTIFICIAL SEQUENCE
  Engineered IL-1R-I binding polypeptide
VDAKYAKEAENAYFEIYELPNLTRKQYTAFIRKLLDDPSQSSELLSEAKKLNDSQAPK

SEQ ID NO: 626 - protein, 58 aa, ARTIFICIAL SEQUENCE
  Engineered IL-1R-I binding polypeptide
VDAKYAKEADAAYWEIYSLPNLTRKQYTAFIRKLLDDPSQSSELLSEAKKLNDSQAPK

SEQ ID NO: 627 - protein, 58 aa, ARTIFICIAL SEQUENCE
  Engineered IL-1R-I binding polypeptide
VDAKYAKEATEAYMEIFALPNLTRKQYTAFIRKLLDDPSQSSELLSEAKKLNDSQAPK

SEQ ID NO: 628 - protein, 58 aa, ARTIFICIAL SEQUENCE
  Engineered IL-1R-I binding polypeptide
VDAKYAKEVHDAYFEIYDLPNLTRKQYTAFIRKLLDDPSQSSELLSEAKKLNDSQAPK

SEQ ID NO: 629 - protein, 58 aa, ARTIFICIAL SEQUENCE
  Engineered IL-1R-I binding polypeptide
VDAKYAKELEFAYQEIFSLPNLTRKQYTAFIRKLLDDPSQSSELLSEAKKLNDSQAPK

SEQ ID NO: 630 - protein, 58 aa, ARTIFICIAL SEQUENCE
  Engineered IL-1R-I binding polypeptide
VDAKYAKEHVAAYFEIYRLPNLTRKQYTAFIRKLLDDPSQSSELLSEAKKLNDSQAPK

SEQ ID NO: 631 - protein, 58 aa, ARTIFICIAL SEQUENCE
  Engineered IL-1R-I binding polypeptide
VDAKYAKEVEVAYMEIFALPNLTRKQYTAFIRKLLDDPSQSSELLSEAKKLNDSQAPK

SEQ ID NO: 632 - protein, 58 aa, ARTIFICIAL SEQUENCE
  Engineered IL-1R-I binding polypeptide
VDAKYAKEVEQAYSEIFNLPNLTRKQYTAFIRKLLDDPSQSSELLSEAKKLNDSQAPK

SEQ ID NO: 633 - protein, 58 aa, ARTIFICIAL SEQUENCE
  Engineered IL-1R-I binding polypeptide
VDAKYAKEAEVAYMEIFALPNLTRKQYTAFIRKLLDDPSQSSELLSEAKKLNDSQAPK

SEQ ID NO: 634 - protein, 58 aa, ARTIFICIAL SEQUENCE
  Engineered IL-1R-I binding polypeptide
VDAKYAKEVEIAYYEIFALPNLTRKQYTAFIRKLLDDPSQSSELLSEAKKLNDSQAPK

SEQ ID NO: 635 - protein, 58 aa, ARTIFICIAL SEQUENCE
  Engineered IL-1R-I binding polypeptide
VDAKYAKEVENAYYEIYQLPNLTRKQYTAFIRKLLDDPSQSSELLSEAKKLNDSQAPK

SEQ ID NO: 636 - protein, 58 aa, ARTIFICIAL SEQUENCE
  Engineered IL-1R-I binding polypeptide
VDAKYAKEAYEAQMEIFALPNLTRKQYTAFIRKLLDDPSQSSELLSEAKKLNDSQAPK

SEQ ID NO: 637 - protein, 58 aa, ARTIFICIAL SEQUENCE
  Engineered IL-1R-I binding polypeptide
VDAKYAKEADQAYWEIYALPNLTRKQYTAFIRKLLDDPSQSSELLSEAKKLNDSQAPK

SEQ ID NO: 638 - protein, 58 aa, ARTIFICIAL SEQUENCE
  Engineered IL-1R-I binding polypeptide
VDAKYAKELHHAYDEIFQLPNLTRKQYTAFIRKLLDDPSQSSELLSEAKKLNDSQAPK

SEQ ID NO: 639 - protein, 58 aa, ARTIFICIAL SEQUENCE
  Engineered IL-1R-I binding polypeptide
VDAKYAKEVEEAYQEIFHLPNLTRRQYTAFIRKLLDDPSQSSELLSEAKKLNDSQAPK

SEQ ID NO: 640 - protein, 58 aa, ARTIFICIAL SEQUENCE
  Engineered IL-1R-I binding polypeptide
VDAKYAKEVEAAYYEIFSLPNLTRKQYTAFIRKLLDDPSQSSELLSEAKKLNDSQAPK

SEQ ID NO: 641 - protein, 58 aa, ARTIFICIAL SEQUENCE
  Engineered IL-1R-I binding polypeptide
VDAKYAKEVEIAQYEIFALPNLTRKQYTAFIRKLLDDPSQSSELLSEAKKLNDSQAPK

SEQ ID NO: 642 - protein, 58 aa, ARTIFICIAL SEQUENCE
  Engineered IL-1R-I binding polypeptide
VDAKYAKEVEEAYFEIYDLPNLTRKQYTAFIRKLLDDPSQSSELLSEAKKLNDSQAPK

SEQ ID NO: 643 - protein, 58 aa, ARTIFICIAL SEQUENCE
  Engineered IL-1R-I binding polypeptide
VDAKYAKETESAYWEIYKLPNLTRKQYTAFIRKLLDDPSQSSELLSEAKKLNDSQAPK

SEQ ID NO: 644 - protein, 58 aa, ARTIFICIAL SEQUENCE
  Engineered IL-1R-I binding polypeptide
VDAKYAKEVERAYYEIFELPNLTRKQYTAFIRKLLDDPSQSSELLSEAKKLNDSQAPK

SEQ ID NO: 645 - protein, 58 aa, ARTIFICIAL SEQUENCE
  Engineered IL-1R-I binding polypeptide
VDAKYAKEAEEAYMEIFALPNLTRKQYTAFIRKLLDDPSQSSELLSEAKKLNDSQAPK

SEQ ID NO: 646 - protein, 58 aa, ARTIFICIAL SEQUENCE
  Engineered IL-1R-I binding polypeptide
VDAKYAKEVERAQMEIFELPNLTRKQYTAFIRKLLDDPSQSSELLSEAKKLNDSQAPK

SEQ ID NO: 647 - protein, 58 aa, ARTIFICIAL SEQUENCE
  Engineered IL-1R-I binding polypeptide
VDAKYAKETEQAYMEIYALPNLTRKQYTAFIRKLLDDPSQSSELLSEAKKLNDSQAPK

SEQ ID NO: 648 - protein, 58 aa, ARTIFICIAL SEQUENCE
  Engineered IL-1R-I binding polypeptide
VDAKYAKEVERAYFEIFALPNLTRKQYTAFIRKLLDDPSQSSELLSEAKKLNDSQAPK

SEQ ID NO: 649 - protein, 58 aa, ARTIFICIAL SEQUENCE
  Engineered IL-1R-I binding polypeptide
VDAKYAKEVEQAYFEIFELPNLTRKQYTAFIRKLLDDPSQSSELLSEAKKLNDSQAPK

SEQ ID NO: 650 - protein, 58 aa, ARTIFICIAL SEQUENCE
  Engineered IL-1R-I binding polypeptide
VDAKYAKEVQKAYFEIYDLPNLTRKQYTAFIRKLLDDPSQSSELLSEAKKLNDSQAPK

SEQ ID NO: 651 - protein, 58 aa, ARTIFICIAL SEQUENCE
  Engineered IL-1R-I binding polypeptide
VDAKYAKEVEAAYMEIYELPNLTRKQYTAFIRKLLDDPSQSSELLSEAKKLNDSQAPK

SEQ ID NO: 652 - protein, 58 aa, ARTIFICIAL SEQUENCE
  Engineered IL-1R-I binding polypeptide
VDAKYAKEVEEAYFEIYALPNLTRRQYTAFIRKLLDDPSQSSELLSEAKKLNDSQAPK

SEQ ID NO: 653 - protein, 58 aa, ARTIFICIAL SEQUENCE
  Engineered IL-1R-I binding polypeptide
VDAKYAKELEDAYMEIYSLPNLTRKQYTAFIRKLLDDPSQSSELLSEAKKLNDSQAPK

SEQ ID NO: 654 - protein, 58 aa, ARTIFICIAL SEQUENCE
  Engineered IL-1R-I binding polypeptide
VDAKYAKEVVDAYDEIFHLPNLTRKQYTAFIRKLLDDPSQSSELLSEAKKLNDSQAPK

SEQ ID NO: 655 - protein, 58 aa, ARTIFICIAL SEQUENCE
  Engineered IL-1R-I binding polypeptide
VDAKYAKEVVDAYDEIFRLPNLTRKQYTAFIRKLLDDPSQSSELLSEAKKLNDSQAPK

SEQ ID NO: 656 - protein, 58 aa, ARTIFICIAL SEQUENCE
  Engineered IL-1R-I binding polypeptide
VDAKYAKEVEDAYEEIYALPNLTRKQYTAFIRKLLDDPSQSSELLSEAKKLNDSQAPK

SEQ ID NO: 657 - protein, 58 aa, ARTIFICIAL SEQUENCE
  Engineered IL-1R-I binding polypeptide
VDAKYAKEAEEAYWEIYELPNLTRKQYTAFIRKLLDDPSQSSELLSEAKKLNDSQAPK

SEQ ID NO: 658 - protein, 58 aa, ARTIFICIAL SEQUENCE
  Engineered IL-1R-I binding polypeptide
VDAKYAKEVEVAQMEIFDLPNLTRKQYTAFIRKLLDDPSQSSELLSEAKKLNDSQAPK

SEQ ID NO: 659 - protein, 58 aa, ARTIFICIAL SEQUENCE
  Engineered IL-1R-I binding polypeptide
VDAKYAKEVEVAQMEIFGLPNLTRKQYTAFIRKLLDDPSQSSELLSEAKKLNDSQAPK

SEQ ID NO: 660 - protein, 58 aa, ARTIFICIAL SEQUENCE
  Engineered IL-1R-I binding polypeptide
VDAKYAKELEAAQMEIFELPNLTRKQYTAFIRKLLDDPSQSSELLSEAKKLNDSQAPK

SEQ ID NO: 661 - protein, 58 aa, ARTIFICIAL SEQUENCE
  Engineered IL-1R-I binding polypeptide
VDAKYAKEVEEAYFEIYNLPNLTRKQYTAFIRKLLDDPSQSSELLSEAKKLNDSQAPK

SEQ ID NO: 662 - protein, 58 aa, ARTIFICIAL SEQUENCE
  Engineered IL-1R-I binding polypeptide
VDAKYAKEVEQAYMEIYELPNLTRKQYTAFIRKLLDDPSQSSELLSEAKKLNDSQAPK

SEQ ID NO: 663 - protein, 58 aa, ARTIFICIAL SEQUENCE
  Engineered IL-1R-I binding polypeptide
VDAKYAKEVHDAYEEIFILPNLTRKQYTAFIRKLLDDPSQSSELLSEAKKLNDSQAPK

SEQ ID NO: 664 - protein, 58 aa, ARTIFICIAL SEQUENCE
  Engineered IL-1R-I binding polypeptide
VDAKYAKEVEVAYMEIFNLPNLTRKQYTAFIRKLLDDPSQSSELLSEAKKLNDSQAPK

SEQ ID NO: 665 - protein, 58 aa, ARTIFICIAL SEQUENCE
  Engineered IL-1R-I binding polypeptide
VDAKYAKEAEHAYFEIFALPNLTRKQYTAFIRKLLDDPSQSSELLSEAKKLNDSQAPK

SEQ ID NO: 666 - protein, 58 aa, ARTIFICIAL SEQUENCE
  Engineered IL-1R-I binding polypeptide
VDAKYAKEIEVAQMEIYNLPNLTRKQYTAFIRKLLDDPSQSSELLSEAKKLNDSQAPK

SEQ ID NO: 667 - protein, 58 aa, ARTIFICIAL SEQUENCE
  Engineered IL-1R-I binding polypeptide
VDAKYAKEAEDAYMEIYALPNLTRKQYTAFIRKLLDDPSQSSELLSEAKKLNDSQAPK

SEQ ID NO: 668 - protein, 58 aa, ARTIFICIAL SEQUENCE
  Engineered IL-1R-I binding polypeptide
VDAKYAKEVEHAYFEIFALPNLTRKQYTAFIRKLLDDPSQSSELLSEAKKLNDSQAPK

SEQ ID NO: 669 - protein, 58 aa, ARTIFICIAL SEQUENCE
  Engineered IL-1R-I binding polypeptide
VDAKYAKETENAYFEIYHLPNLTRKQYTAFIRKLLDDPSQSSELLSEAKKLNDSQAPK

SEQ ID NO: 670 - protein, 58 aa, ARTIFICIAL SEQUENCE
  Engineered IL-1R-I binding polypeptide
VDAKYAKEVEQAYFEIFALPNLTRKQYTAFIRKLLDDPSQSSELLSEAKKLNDSQAPK

SEQ ID NO: 671 - protein, 58 aa, ARTIFICIAL SEQUENCE
  Engineered IL-1R-I binding polypeptide
VDAKYAKEAEDAYMEIYSLPNLTRKQYTAFIRKLLDDPSQSSELLSEAKKLNDSQAPK

SEQ ID NO: 672 - protein, 58 aa, ARTIFICIAL SEQUENCE
  Engineered IL-1R-I binding polypeptide
VDAKYAKEVEDAYEEIYQLPNLTRKQYTAFIRKLLDDPSQSSELLSEAKKLNDSQAPK

SEQ ID NO: 673 - protein, 58 aa, ARTIFICIAL SEQUENCE
  Engineered IL-1R-I binding polypeptide
VDAKYAKELESAYFEIYGLPNLTRRQYTAFIRKLLDDPSQSSELLSEAKKLNDSQAPK

SEQ ID NO: 674 - protein, 58 aa, ARTIFICIAL SEQUENCE
  Engineered IL-1R-I binding polypeptide
VDAKYAKEVVTAYYEIFELPNLTRKQYTAFIRKLLDDPSQSSELLSEAKKLNDSQAPK

SEQ ID NO: 675 - protein, 58 aa, ARTIFICIAL SEQUENCE
  Engineered IL-1R-I binding polypeptide
VDAKYAKEQEDAYWEIYGLPNLTRKQYTAFIRKLLDDPSQSSELLSEAKKLNDSQAPK

SEQ ID NO: 676 - protein, 58 aa, ARTIFICIAL SEQUENCE
  Engineered IL-1R-I binding polypeptide
VDAKYAKEVQAAYFEIFALPNLTRRQYTAFIRKLLDDPSQSSELLSEAKKLNDSQAPK

SEQ ID NO: 677 - protein, 58 aa, ARTIFICIAL SEQUENCE
  Engineered IL-1R-I binding polypeptide
VDAKYAKEAVNAYFEIYELPNLTRKQYTAFIRKLLDDPSQSSELLSEAKKLNDSQAPK

SEQ ID NO: 678 - protein, 58 aa, ARTIFICIAL SEQUENCE
  Engineered IL-1R-I binding polypeptide
VDAKYAKEVEHAQMEIYGLPNLTRKQYTAFIRKLLDDPSQSSELLSEAKKLNDSQAPK

SEQ ID NO: 679 - protein, 58 aa, ARTIFICIAL SEQUENCE
  Engineered IL-1R-I binding polypeptide
VDAKYAKEVEAAYFEIYSLPNLTRKQYTAFIRKLLDDPSQSSELLSEAKKLNDSQAPK

SEQ ID NO: 680 - protein, 58 aa, ARTIFICIAL SEQUENCE
  Engineered IL-1R-I binding polypeptide
VDAKYAKEIEIAQMEIFALPNLTRKQYTAFIRKLLDDPSQSSELLSEAKKLNDSQAPK

SEQ ID NO: 681 - protein, 58 aa, ARTIFICIAL SEQUENCE
  Engineered IL-1R-I binding polypeptide
VDAKYAKELENAYFEIYGLPNLTRKQYTAFIRKLLDDPSQSSELLSEAKKLNDSQAPK

SEQ ID NO: 682 - protein, 58 aa, ARTIFICIAL SEQUENCE
  Engineered IL-1R-I binding polypeptide
VDAKYAKEVEAAYFEIYNLPNLTRKQYTAFIRKLLDDPSQSSELLSEAKKLNDSQAPK

SEQ ID NO: 683 - protein, 58 aa, ARTIFICIAL SEQUENCE
  Engineered IL-1R-I binding polypeptide
VDAKYAKELEWAQMEIFYLPNLTRKQYTAFIRKLLDDPSQSSELLSEAKKLNDSQAPK

SEQ ID NO: 684 - protein, 58 aa, ARTIFICIAL SEQUENCE
  Engineered IL-1R-I binding polypeptide
VDAKYAKEADDAYWEIYALPNLTRKQYTAFIRKLLDDPSQSSELLSEAKKLNDSQAPK

SEQ ID NO: 685 - protein, 58 aa, ARTIFICIAL SEQUENCE
  Engineered IL-1R-I binding polypeptide
VDAKYAKEVELAQMEIFKLPNLTRRQYTAFIRKLLDDPSQSSELLSEAKKLNDSQAPK

SEQ ID NO: 686 - protein, 58 aa, ARTIFICIAL SEQUENCE
  Engineered IL-1R-I binding polypeptide
VDAKYAKEIHEAQMEIFKLPNLTRKQYTAFIRKLLDDPSQSSELLSEAKKLNDSQAPK

SEQ ID NO: 687 - protein, 58 aa, ARTIFICIAL SEQUENCE
  Engineered IL-1R-I binding polypeptide
VDAKYAKEVEYAYFEIFKLPNLTRKQYTAFIRKLLDDPSQSSELLSEAKKLNDSQAPK

SEQ ID NO: 688 - protein, 58 aa, ARTIFICIAL SEQUENCE
  Engineered IL-1R-I binding polypeptide
VDAKYAKEAYTAQMEIFSLPNLTRKQYTAFIRKLLDDPSQSSELLSEAKKLNDSQAPK

SEQ ID NO: 689 - protein, 58 aa, ARTIFICIAL SEQUENCE
  Engineered IL-1R-I binding polypeptide
VDAKYAKEAENAYWEIYALPNLTRKQYTAFIRKLLDDPSQSSELLSEAKKLNDSQAPK

SEQ ID NO: 690 - protein, 58 aa, ARTIFICIAL SEQUENCE
  Engineered IL-1R-I binding polypeptide
VDAKYAKEVERAYMEIFGLPNLTRKQYTAFIRKLLDDPSQSSELLSEAKKLNDSQAPK

SEQ ID NO: 691 - protein, 58 aa, ARTIFICIAL SEQUENCE
  Engineered IL-1R-I binding polypeptide
VDAKYAKEIEEAQMEIFWLPNLTRKQYTAFIRKLLDDPSQSSELLSEAKKLNDSQAPK

SEQ ID NO: 692 - protein, 58 aa, ARTIFICIAL SEQUENCE
  Engineered IL-1R-I binding polypeptide
VDAKYAKEIEDAYMEIYALPNLTRKQYTAFIRKLLDDPSQSSELLSEAKKLNDSQAPK

SEQ ID NO: 693 - protein, 58 aa, ARTIFICIAL SEQUENCE
  Engineered IL-1R-I binding polypeptide
VDAKYAKEVVKAYYEIYELPNLTRRQYTAFIRKLLDDPSQSSELLSEAKKLNDSQAPK

SEQ ID NO: 694 - protein, 58 aa, ARTIFICIAL SEQUENCE
  Engineered IL-1R-I binding polypeptide
VDAKYAKELENAYAEIFHLPNLTRKQYTAFIRKLLDDPSQSSELLSEAKKLNDSQAPK

SEQ ID NO: 695 - protein, 58 aa, ARTIFICIAL SEQUENCE
  Engineered IL-1R-I binding polypeptide
VDAKYAKEQISAYWEIYALPNLTRKQYTAFIRKLLDDPSQSSELLSEAKKLNDSQAPK

SEQ ID NO: 696 - protein, 58 aa, ARTIFICIAL SEQUENCE
  Engineered IL-1R-I binding polypeptide
VDAKYAKETEDAYMEIYNLPNLTRKQYTAFIRKLLDDPSQSSELLSEAKKLNDSQAPK

SEQ ID NO: 697 - protein, 58 aa, ARTIFICIAL SEQUENCE
  Engineered IL-1R-I binding polypeptide
VDAKYAKEVEDAYMEIYNLPNLTRKQYTAFIRKLLDDPSQSSELLSEAKKLNDSQAPK

SEQ ID NO: 698 - protein, 58 aa, ARTIFICIAL SEQUENCE
  Engineered IL-1R-I binding polypeptide
VDAKYAKEVEDAQYEIFDLPNLTRKQYTAFIRKLLDDPSQSSELLSEAKKLNDSQAPK

SEQ ID NO: 699 - protein, 58 aa, ARTIFICIAL SEQUENCE
  Engineered IL-1R-I binding polypeptide
VDAKYAKEVERAQMEIFDLPNLTRKQYTAFIRKLFDDPSQSSELLSEAKKLNDSQAPK

SEQ ID NO: 700 - protein, 58 aa, ARTIFICIAL SEQUENCE
  Engineered IL-1R-I binding polypeptide
VDAKYAKEAHEAQMEIFYLPNLTRKQYTAFIRKLLDDPSQSSELLSEAKKLNDSQAPK

SEQ ID NO: 701 - protein, 58 aa, ARTIFICIAL SEQUENCE
  Engineered IL-1R-I binding polypeptide
VDAKYAKETYNAQQEIFNLPNLTRRQYTAFIRKLLDDPSQSSELLSEAKKLNDSQAPK

SEQ ID NO: 702 - protein, 58 aa, ARTIFICIAL SEQUENCE
  Engineered IL-1R-I binding polypeptide
VDAKYAKEVEDAQLEIFALPNLTRKQYTAFIRKLLDDPSQSSELLSEAKKLNDSQAPK

SEQ ID NO: 703 - protein, 58 aa, ARTIFICIAL SEQUENCE
  Engineered IL-1R-I binding polypeptide
VDAKYAKEIEKAQMEIFFLPNLTRKQYTAFIRKLFDDPSQSSELLSEAKKLNDSQAPK

SEQ ID NO: 704 - protein, 58 aa, ARTIFICIAL SEQUENCE
  Engineered IL-1R-I binding polypeptide
VDAKYAKEIEKAQMEIFGLPNLTRKQYTAFIRKLLDDPSQSSELLSEAKKLNDSQAPK

SEQ ID NO: 705 - protein, 58 aa, ARTIFICIAL SEQUENCE
  Engineered IL-1R-I binding polypeptide
VDAKYAKEVELAQMEIFALPNLTRKQYTAFIRKLFDDPSQSSELLSEAKKLNDSQAPK

SEQ ID NO: 706 - protein, 58 aa, ARTIFICIAL SEQUENCE
  Engineered IL-1R-I binding polypeptide
VDAKYAKEVEHAQMEIFNLPNLTRKQYTAFIRKLLDDPSQSSELLSEAKKLNDSQAPK

SEQ ID NO: 707 - protein, 58 aa, ARTIFICIAL SEQUENCE
  Engineered IL-1R-I binding polypeptide
VDAKYAKETESAQMEIFGLPNLTRKQYTAFIRKLLDDPSQSSELLSEAKKLNDSQAPK

SEQ ID NO: 708 - protein, 58 aa, ARTIFICIAL SEQUENCE
  Engineered IL-1R-I binding polypeptide
VDAKYAKEIEVAQLEIFKLPNLTRKQYTAFIRKLFDDPSQSSELLSEAKKLNDSQAPK

SEQ ID NO: 709 - protein, 58 aa, ARTIFICIAL SEQUENCE
  Engineered IL-1R-I binding polypeptide
VDAKYAKEVETAQMEIFALPNLTRRQYTAFIRKLLDDPSQSSELLSEAKKLNDSQAPK

SEQ ID NO: 710 - protein, 58 aa, ARTIFICIAL SEQUENCE
  Engineered IL-1R-I binding polypeptide
VDAKYAKELESAQMEIFYLPNLTRKQYTAFIRKLLDDPSQSSELLSEAKKLNDSQAPK

SEQ ID NO: 711 - protein, 58 aa, ARTIFICIAL SEQUENCE
  Engineered IL-1R-I binding polypeptide
VDAKYAKETEEAQMEIFGLPNLTRKQYTAFIRKLLDDPSQSSELLSEAKKLNDSQAPK

SEQ ID NO: 712 - protein, 58 aa, ARTIFICIAL SEQUENCE
  Engineered IL-1R-I binding polypeptide
VDAKYAKEVEVAQMEIFNLPNLTRKQYTAFIRKLLDDPSQSSELLSEAKKLNDSQAPK

SEQ ID NO: 713 - protein, 58 aa, ARTIFICIAL SEQUENCE
  Engineered IL-1R-I binding polypeptide
VDAKYAKEVIVAYEEIFQLPNLTRKQYTAFIRKLLDDPSQSSELLSEAKKLNDSQAPK

SEQ ID NO: 714 - protein, 58 aa, ARTIFICIAL SEQUENCE
  Engineered IL-1R-I binding polypeptide
VDAKYAKEVETAQMEIFSLPNLTRKQYTAFIRKLLDDPSQSSELLSEAKKLNDSQAPK

SEQ ID NO: 715 - protein, 58 aa, ARTIFICIAL SEQUENCE
  Engineered IL-1R-I binding polypeptide
VDAKYAKEIEAAQMEIFNLPNLTRKQYTAFIRKLLDDPSQSSELLSEAKKLNDSQAPK

SEQ ID NO: 716 - protein, 58 aa, ARTIFICIAL SEQUENCE
  Engineered IL-1R-I binding polypeptide
VDAKYAKELEKAQMEIFNLPNLTRKQYTAFIRKLLDDPSQSSELLSEAKKLNDSQAPK

SEQ ID NO: 717 - protein, 58 aa, ARTIFICIAL SEQUENCE
  Engineered IL-1R-I binding polypeptide
VDAKYAKETESAQMEIFALPNLTRKQYTAFIRKLLDDPSQSSELLSEAKKLNDSQAPK

SEQ ID NO: 718 - protein, 58 aa, ARTIFICIAL SEQUENCE
  Engineered IL-1R-I binding polypeptide
VDAKYAKELESAQMEIFALPNLTRKQYTAFIRKLFDDPSQSSELLSEAKKLNDSQAPK

SEQ ID NO: 719 - protein, 58 aa, ARTIFICIAL SEQUENCE
  Engineered IL-1R-I binding polypeptide
VDAKYAKETEDAQMEIYRLPNLTRKQYTAFIRKLLDDPSQSSELLSEAKKLNDSQAPK

SEQ ID NO: 720 - protein, 58 aa, ARTIFICIAL SEQUENCE
  Engineered IL-1R-I binding polypeptide
VDAKYAKEIYVAQMEIFGLPNLTRKQYTAFIRKLLDDPSQSSELLSEAKKLNDSQAPK

SEQ ID NO: 721 - protein, 58 aa, ARTIFICIAL SEQUENCE
  Engineered IL-1R-I binding polypeptide
VDAKYAKETEQAQMEIFSLPNLTRRQYTAFIRKLLDDPSQSSELLSEAKKLNDSQAPK

SEQ ID NO: 722 - protein, 58 aa, ARTIFICIAL SEQUENCE
  Engineered IL-1R-I binding polypeptide
VDAKYAKEAYKAQMEIFKLPNLTRRQYTAFIRKLLDDPSQSSELLSEAKKLNDSQAPK

SEQ ID NO: 723 - protein, 58 aa, ARTIFICIAL SEQUENCE
  Engineered IL-1R-I binding polypeptide
VDAKYAKEIEDAQMEIFELPNLTRRQYTAFIRKLLDDPSQSSELLSEAKKLNDSQAPK

SEQ ID NO: 724 - protein, 58 aa, ARTIFICIAL SEQUENCE
  Engineered IL-1R-I binding polypeptide
VDAKYAKEVEIAQMEIFNLPNLTRKQYTAFIRKLLDDPSQSSELLSEAKKLNDSQAPK

SEQ ID NO: 725 - protein, 58 aa, ARTIFICIAL SEQUENCE
  Engineered IL-1R-I binding polypeptide
VDAKYAKEVEFAYMEIFRLPNLTRKQYTAFIRKLLDDPSQSSELLSEAKKLNDSQAPK

SEQ ID NO: 726 - protein, 58 aa, ARTIFICIAL SEQUENCE
  Engineered IL-1R-I binding polypeptide
VDAKYAKEIERAQMEIYELPNLTRKQYTAFIRKLFDDPSQSSELLSEAKKLNDSQAPK

SEQ ID NO: 727 - protein, 58 aa, ARTIFICIAL SEQUENCE
  Engineered IL-1R-I binding polypeptide
VDAKYAKEVDEAYMEIYNLPNLTRRQYTAFIRKLLDDPSQSSELLSEAKKLNDSQAPK

SEQ ID NO: 728 - protein, 58 aa, ARTIFICIAL SEQUENCE
  Engineered IL-1R-I binding polypeptide
VDAKYAKEVEEAQLEIFALPNLTRKQYTAFIRKLFDDPSQSSELLSEAKKLNDSQAPK

SEQ ID NO: 729 - protein, 58 aa, ARTIFICIAL SEQUENCE
  Engineered IL-1R-I binding polypeptide
VDAKYAKETHDAQMEIFELPNLTRKQYTAFIRKLFDDPSQSSELLSEAKKLNDSQAPK

SEQ ID NO: 730 - protein, 58 aa, ARTIFICIAL SEQUENCE
  Engineered IL-1R-I binding polypeptide
VDAKYAKETEDAQMEIFGLPNLTRKQYTAFIRKLLDDPSQSSELLSEAKKLNDSQAPK

SEQ ID NO: 731 - protein, 58 aa, ARTIFICIAL SEQUENCE
  Engineered IL-1R-I binding polypeptide
VDAKYAKETERAYYEIFALPNLTRKQYTAFIRKLLDDPSQSSELLSEAKKLNDSQAPK

SEQ ID NO: 732 - protein, 58 aa, ARTIFICIAL SEQUENCE
  Engineered IL-1R-I binding polypeptide
VDAKYAKEVEDAQMEIYYLPNLTRRQYTAFIRKLLDDPSQSSELLSEAKKLNDSQAPK

SEQ ID NO: 733 - protein, 58 aa, ARTIFICIAL SEQUENCE
  Engineered IL-1R-I binding polypeptide
VDAKYAKEAEQAYFEIYELPNLTRRQYTAFIRKLLDDPSQSSELLSEAKKLNDSQAPK

SEQ ID NO: 734 - protein, 58 aa, ARTIFICIAL SEQUENCE
  Engineered IL-1R-I binding polypeptide
VDAKYAKEVEEAQMEIFNLPNLTRRQYTAFIRKLLDDPSQSSELLSEAKKLNDSQAPK

SEQ ID NO: 735 - protein, 58 aa, ARTIFICIAL SEQUENCE
  Engineered IL-1R-I binding polypeptide
VDAKYAKEVEVAQMEIFNLPNLTRKQYTAFIRKLFDDPSQSSELLSEAKKLNDSQAPK

SEQ ID NO: 736 - protein, 58 aa, ARTIFICIAL SEQUENCE
  Engineered IL-1R-I binding polypeptide
VDAKYAKEIEQAQMEIYFLPNLTRKQYTAFIIKLFDDPSQSSELLSEAKKLNDSQAPK

SEQ ID NO: 737 - protein, 58 aa, ARTIFICIAL SEQUENCE
  Engineered IL-1R-I binding polypeptide
VDAKYAKEVEWAQMEIFYLPNLTRKQYTAFIRKLFDDPSQSSELLSEAKKLNDSQAPK

SEQ ID NO: 738 - protein, 58 aa, ARTIFICIAL SEQUENCE
  Engineered IL-1R-I binding polypeptide
VDAKYAKEVESAQMEIFKLPNLTRKQYTAFIRKLFDDPSQSSELLSEAKKLNDSQAPK

SEQ ID NO: 739 - protein, 58 aa, ARTIFICIAL SEQUENCE
  Engineered IL-1R-I binding polypeptide
VDAKYAKEAEVAQMEIFALPNLTRKQYTAFIRKLLDDPSQSSELLSEAKKLNDSQAPK

SEQ ID NO: 740 - protein, 58 aa, ARTIFICIAL SEQUENCE
  Engineered IL-1R-I binding polypeptide
VDAKYAKEIEKAQMEIYYLPNLTRKQYTAFIRKLLDDPSQSSELLSEAKKLNDSQAPK

SEQ ID NO: 741 - protein, 58 aa, ARTIFICIAL SEQUENCE
  Engineered IL-1R-I binding polypeptide
VDAKYAKEIEKAQLEIFALPNLTRKQYTAFIRKLFDDPSQSSELLSEAKKLNDSQAPK

SEQ ID NO: 742 - protein, 58 aa, ARTIFICIAL SEQUENCE
  Engineered IL-1R-I binding polypeptide
VDAKYAKETERAQMEIFQLPNLTRKQYTAFIRKLLDDPSQSSELLSEAKKLNDSQAPK

SEQ ID NO: 743 - protein, 58 aa, ARTIFICIAL SEQUENCE
  Engineered IL-1R-I binding polypeptide
VDAKYAKEVQDAQMEIFYLPNLTRKQYTAFIRKLLDDPSQSSELLSEAKKLNDSQAPK

SEQ ID NO: 744 - protein, 58 aa, ARTIFICIAL SEQUENCE
  Engineered IL-1R-I binding polypeptide
VDAKYAKEIEAAQMEIFVLPNLTRKQYTAFIRKLLDDPSQSSELLSEAKKLNDSQAPK

SEQ ID NO: 745 - protein, 58 aa, ARTIFICIAL SEQUENCE
  Engineered IL-1R-I binding polypeptide
VDAKYAKELQRAQMEIFELPNLTRRQYTAFIRKLFDDPSQSSELLSEAKKLNDSQAPK

SEQ ID NO: 746 - protein, 58 aa, ARTIFICIAL SEQUENCE
  Engineered IL-1R-I binding polypeptide
VDAKYAKELEEAQMEIFLLPNLTRRQYTAFIRKLLDDPSQSSELLSEAKKLNDSQAPK

SEQ ID NO: 747 - protein, 58 aa, ARTIFICIAL SEQUENCE
  Engineered IL-1R-I binding polypeptide
VDAKYAKEIEHAQMEIFALPNLTRKQYTAFIRKLFDDPSQSSELLSEAKKLNDSQAPK

SEQ ID NO: 748 - protein, 58 aa, ARTIFICIAL SEQUENCE
  Engineered IL-1R-I binding polypeptide
VDAKYAKEVYQAQMEIFGLPNLTRKQYTAFIRKLLDDPSQSSELLSEAKKLNDSQAPK

SEQ ID NO: 749 - protein, 58 aa, ARTIFICIAL SEQUENCE
  Engineered IL-1R-I binding polypeptide
VDAKYAKEIEAAQMEIFYLPNLTRRQYTAFIRKLFDDPSQSSELLSEAKKLNDSQAPK

SEQ ID NO: 750 - protein, 58 aa, ARTIFICIAL SEQUENCE
  Engineered IL-1R-I binding polypeptide
VDAKYAKEAKDAQMEIFGLPNLTRRQYTAFIRKLLDDPSQSSELLSEAKKLNDSQAPK

SEQ ID NO: 751 - protein, 58 aa, ARTIFICIAL SEQUENCE
  Engineered IL-1R-I binding polypeptide
VDAKYAKEVETAYMEIYYLPNLTRKQYTAFIRKLLDDPSQSSELLSEAKKLNDSQAPK

SEQ ID NO: 752 - protein, 58 aa, ARTIFICIAL SEQUENCE
  Engineered IL-1R-I binding polypeptide
VDAKYAKEVEAAQMEIYALPNLTRKQYTAFIRKLLDDPSQSSELLSEAKKLNDSQAPK

SEQ ID NO: 753 - protein, 58 aa, ARTIFICIAL SEQUENCE
  Engineered IL-1R-I binding polypeptide
VDAKYAKEVEAAYWEIFKLPNLTRKQYTAFIRKLLDDPSQSSELLSEAKKLNDSQAPK

SEQ ID NO: 754 - protein, 58 aa, ARTIFICIAL SEQUENCE
  Engineered IL-1R-I binding polypeptide
VDAKYAKEIEQAQMEIYELPNLTRKQYTAFIRKLLDDPSQSSELLSEAKKLNDSQAPK

SEQ ID NO: 755 - protein, 58 aa, ARTIFICIAL SEQUENCE
  Engineered IL-1R-I binding polypeptide
VDAKYAKETEEAYFEIYELPNLTRKQYTAFIRKLLDDPSQSSELLSEAKKLNDSQAPK

SEQ ID NO: 756 - protein, 58 aa, ARTIFICIAL SEQUENCE
  Engineered IL-1R-I binding polypeptide
VDAKYAKEVEWAQMEIFKLPNLTRRQYTAFIRKLLDDPSQSSELLSEAKKLNDSQAPK

SEQ ID NO: 757 - protein, 58 aa, ARTIFICIAL SEQUENCE
  Engineered IL-1R-I binding polypeptide
VDAKYAKEIEIAQMEIFELPNLTRKQYTAFIRKLLDDPSQSSELLSEAKKLNDSQAPK

SEQ ID NO: 758 - protein, 58 aa, ARTIFICIAL SEQUENCE
  Engineered IL-1R-I binding polypeptide
VDAKYAKEAEAAQMEIFALPNLTRKQYTAFIRKLLDDPSQSSELLSEAKKLNDSQAPK

SEQ ID NO: 759 - protein, 58 aa, ARTIFICIAL SEQUENCE
  Engineered IL-1R-I binding polypeptide
VDAKYAKEVVSAYEEIFHLPNLTRKQYTAFIRKLLDDPSQSSELLSEAKKLNDSQAPK

SEQ ID NO: 760 - protein, 58 aa, ARTIFICIAL SEQUENCE
  Engineered IL-1R-I binding polypeptide
VDAKYAKETEDAQMEIFALPNLTRRQYTAFIRKLLDDPSQSSELLSEAKKLNDSQAPK

SEQ ID NO: 761 - protein, 58 aa, ARTIFICIAL SEQUENCE
  Engineered IL-1R-I binding polypeptide
VDAKYAKEVEFAQMEIFELPNLTRKQYTAFIRKLLDDPSQSSELLSEAKKLNDSQAPK

SEQ ID NO: 762 - protein, 58 aa, ARTIFICIAL SEQUENCE
  Engineered IL-1R-I binding polypeptide
VDAKYAKEVQNAQMEIFALPNLTRKQYTAFIRKLLDDPSQSSELLSEAKKLNDSQAPK

SEQ ID NO: 763 - protein, 58 aa, ARTIFICIAL SEQUENCE
  Engineered IL-1R-I binding polypeptide
VDAKYAKEAQRAYMEIYQLPNLTRKQYTAFIRKLLDDPSQSSELLSEAKKLNDSQAPK

SEQ ID NO: 764 - protein, 58 aa, ARTIFICIAL SEQUENCE
  Engineered IL-1R-I binding polypeptide
VDAKYAKEIEDAQMEIYGLPNLTRKQYTAFIRKLLDDPSQSSELLSEAKKLNDSQAPK

SEQ ID NO: 765 - protein, 58 aa, ARTIFICIAL SEQUENCE
  Engineered IL-1R-I binding polypeptide
VDAKYAKEVEYAQMEIFSLPNLTRKQYTAFIRKLFDDPSQSSELLSEAKKLNDSQAPK

SEQ ID NO: 766 - protein, 58 aa, ARTIFICIAL SEQUENCE
  Engineered IL-1R-I binding polypeptide
VDAKYAKEAEDAQMEIFALPNLTRRQYTAFIRKLLDDPSQSSELLSEAKKLNDSQAPK

SEQ ID NO: 767 - protein, 58 aa, ARTIFICIAL SEQUENCE
  Engineered IL-1R-I binding polypeptide
VDAKYAKEVESAQMEIFDLPNLTRKQYTAFIRKLFDDPSQSSELLSEAKKLNDSQAPK

SEQ ID NO: 768 - protein, 58 aa, ARTIFICIAL SEQUENCE
  Engineered IL-1R-I binding polypeptide
VDAKYAKEVDVAYMEIFGLPNLTRKQYTAFIRKLLDDPSQSSELLSEAKKLNDSQAPK

SEQ ID NO: 769 - protein, 58 aa, ARTIFICIAL SEQUENCE
  Engineered IL-1R-I binding polypeptide
VDAKYAKEVEDAQMEIFSLPNLTRKQYTAFIRKLFDDPSQSSELLSEAKKLNDSQAPK

SEQ ID NO: 770 - protein, 58 aa, ARTIFICIAL SEQUENCE
  Engineered IL-1R-I binding polypeptide
VDAKYAKEVEAAQMEIFDLPNLTRKQYTAFIRKLLDDPSQSSELLSEAKKLNDSQAPK

SEQ ID NO: 771 - protein, 58 aa, ARTIFICIAL SEQUENCE
  Engineered IL-1R-I binding polypeptide
VDAKYAKEVEDAYFEIYLLPNLTRKQYTAFIRKLLDDPSQSSELLSEAKKLNDSQAPK

SEQ ID NO: 772 - protein, 58 aa, ARTIFICIAL SEQUENCE
  Engineered IL-1R-I binding polypeptide
VDAKYAKEVEKAQMEIFTLPNLTRKQYTAFIRKLFDDPSQSSELLSEAKKLNDSQAPK

SEQ ID NO: 773 - protein, 58 aa, ARTIFICIAL SEQUENCE
  Engineered IL-1R-I binding polypeptide
VDAKYAKELEKAYFEIYELPNLTRKQYTAFIRKLLDDPSQSSELLSEAKKLNDSQAPK

SEQ ID NO: 774 - protein, 58 aa, ARTIFICIAL SEQUENCE
  Engineered IL-1R-I binding polypeptide
VDAKYAKEVEAAQMEIFALPNLTRKQYTAFIRKLFDDPSQSSELLSEAKKLNDSQAPK

SEQ ID NO: 775 - protein, 58 aa, ARTIFICIAL SEQUENCE
  Engineered IL-1R-I binding polypeptide
VDAKYAKEIREAQMEIFGLPNLTRKQYTAFIRKLFDDPSQSSELLSEAKKLNDSQAPK

SEQ ID NO: 776 - protein, 58 aa, ARTIFICIAL SEQUENCE
  Engineered IL-1R-I binding polypeptide
VDAKYAKEVENAQMEIYNLPNLTRKQYTAFIRKLFDDPSQSSELLSEAKKLNDSQAPK

SEQ ID NO: 777 - protein, 58 aa, ARTIFICIAL SEQUENCE
  Engineered IL-1R-I binding polypeptide
VDAKYAKEVEDAQMEIYDLPNLTRKQYTAFIRKLFDDPSQSSELLSEAKKLNDSQAPK

SEQ ID NO: 778 - protein, 58 aa, ARTIFICIAL SEQUENCE
  Engineered IL-1R-I binding polypeptide
VDAKYAKEVEVAQMEIFGLPNLTRRQYTAFIRKLLDDPSQSSELLSEAKKLNDSQAPK

SEQ ID NO: 779 - protein, 58 aa, ARTIFICIAL SEQUENCE
  Engineered IL-1R-I binding polypeptide
VDAKYAKEVEHAQMEIYYLPNLTRKQYTAFIRKLLDDPSQSSELLSEAKKLNDSQAPK

SEQ ID NO: 780 - protein, 58 aa, ARTIFICIAL SEQUENCE
  Engineered IL-1R-I binding polypeptide
VDAKYAKEAETAQMEIFALPNLTRKQYTAFIRKLLDDPSQSSELLSEAKKLNDSQAPK

SEQ ID NO: 781 - protein, 58 aa, ARTIFICIAL SEQUENCE
  Engineered IL-1R-I binding polypeptide
VDAKYAKEIEQAQMEIFRLPNLTRKQYTAFIRKLLDDPSQSSELLSEAKKLNDSQAPK

SEQ ID NO: 782 - protein, 58 aa, ARTIFICIAL SEQUENCE
  Engineered IL-1R-I binding polypeptide
VDAKYAKEVEAAQMEIFYLPNLTRKQYTAFIRKLFDDPSQSSELLSEAKKLNDSQAPK

SEQ ID NO: 783 - protein, 58 aa, ARTIFICIAL SEQUENCE
  Engineered IL-1R-I binding polypeptide
VDAKYAKEVHEAQMEIFYLPNLTRRQYTAFIRKLLDDPSQSSELLSEAKKLNDSQAPK

SEQ ID NO: 784 - protein, 58 aa, ARTIFICIAL SEQUENCE
  Engineered IL-1R-I binding polypeptide
VDAKYAKEVEHAYMEIFHLPNLTRKQYTAFIRKLLDDPSQSSELLSEAKKLNDSQAPK

SEQ ID NO: 785 - protein, 58 aa, ARTIFICIAL SEQUENCE
  Engineered IL-1R-I binding polypeptide
VDAKYAKEIEKAQMEIFDLPNLTRKQYTAFIRKLFDDPSQSSELLSEAKKLNDSQAPK

SEQ ID NO: 786 - protein, 58 aa, ARTIFICIAL SEQUENCE
  Engineered IL-1R-I binding polypeptide
VDAKYAKETEAAQMEIYNLPNLTRKQYTAFIRKLFDDPSQSSELLSEAKKLNDSQAPK

SEQ ID NO: 787 - protein, 58 aa, ARTIFICIAL SEQUENCE
  Engineered IL-1R-I binding polypeptide
VDAKYAKEVHEAQMEIYNLPNLTRKQYTAFIRKLLDDPSQSSELLSEAKKLNDSQAPK

SEQ ID NO: 788 - protein, 58 aa, ARTIFICIAL SEQUENCE
  Engineered IL-1R-I binding polypeptide
VDAKYAKEIQDAQMEIYYLPNLTRKQYTAFIRKLLDDPSQSSELLSEAKKLNDSQAPK

SEQ ID NO: 789 - protein, 58 aa, ARTIFICIAL SEQUENCE
  Engineered IL-1R-I binding polypeptide
VDAKYAKEVEQAQMEIFLLPNLTRKQYTAFIRKLLDDPSQSSELLSEAKKLNDSQAPK

SEQ ID NO: 790 - protein, 58 aa, ARTIFICIAL SEQUENCE
  Engineered IL-1R-I binding polypeptide
VDAKYAKETEIAQMEIFELPNLTRKQYTAFIRKLLDDPSQSSELLSEAKKLNDSQAPK

SEQ ID NO: 791 - protein, 58 aa, ARTIFICIAL SEQUENCE
  Engineered IL-1R-I binding polypeptide
VDAKYAKEIEEAQLEIFELPNLTRKQYTAFIRKLFDDPSQSSELLSEAKKLNDSQAPK

SEQ ID NO: 792 - protein, 58 aa, ARTIFICIAL SEQUENCE
  Engineered IL-1R-I binding polypeptide
VDAKYAKELERAQMEIFVLPNLTRKQYTAFIRKLLDDPSQSSELLSEAKKLNDSQAPK

SEQ ID NO: 793 - protein, 58 aa, ARTIFICIAL SEQUENCE
  Engineered IL-1R-I binding polypeptide
VDAKYAKETEIAQMEIYSLPNLTRKQYTAFIRKLLDDPSQSSELLSEAKKLNDSQAPK

SEQ ID NO: 794 - protein, 58 aa, ARTIFICIAL SEQUENCE
  Engineered IL-1R-I binding polypeptide
VDAKYAKEAEDAYMEIFRLPNLTRKQYTAFIRKLLDDPSQSSELLSEAKKLNDSQAPK

SEQ ID NO: 795 - protein, 58 aa, ARTIFICIAL SEQUENCE
  Engineered IL-1R-I binding polypeptide
VDAKYAKEVEQAQLEIFSLPNLTRKQYTAFIRKLFDDPSQSSELLSEAKKLNDSQAPK

SEQ ID NO: 796 - protein, 58 aa, ARTIFICIAL SEQUENCE
  Engineered IL-1R-I binding polypeptide
VDAKYAKEIEFAQMEIFYLPNLTRKQYTAFIRKLLDDPSQSSELLSEAKKLNDSQAPK

SEQ ID NO: 797 - protein, 58 aa, ARTIFICIAL SEQUENCE
  Engineered IL-1R-I binding polypeptide
VDAKYAKEIEEAQMEIFFLPNLTRKQYTAFIRKLLDDPSQSSELLSEAKKLNDSQAPK

SEQ ID NO: 798 - protein, 58 aa, ARTIFICIAL SEQUENCE
  Engineered IL-1R-I binding polypeptide
VDAKYAKETYHAQMEIYSLPNLTRKQYTAFIRKLLDDPSQSSELLSEAKKLNDSQAPK

SEQ ID NO: 799 - protein, 58 aa, ARTIFICIAL SEQUENCE
  Engineered IL-1R-I binding polypeptide
VDAKYAKEAEQAYHEIYQLPNLTRKQYTAFIRKLLDDPSQSSELLSEAKKLNDSQAPK

SEQ ID NO: 800 - protein, 58 aa, ARTIFICIAL SEQUENCE
  Engineered IL-1R-I binding polypeptide
VDAKYAKETETAQMEIFSLPNLTRKQYTAFIRKLFDDPSQSSELLSEAKKLNDSQAPK

SEQ ID NO: 801 - protein, 58 aa, ARTIFICIAL SEQUENCE
  Engineered IL-1R-I binding polypeptide
VDAKYAKEAEEAYQEIFHLPNLTRKQYTAFIRKLLDDPSQSSELLSEAKKLNDSQAPK

SEQ ID NO: 802 - protein, 58 aa, ARTIFICIAL SEQUENCE
  Engineered IL-1R-I binding polypeptide
VDAKYAKETEVAQMEIYELPNLTRKQYTAFIRKLLDDPSQSSELLSEAKKLNDSQAPK

SEQ ID NO: 803 - protein, 58 aa, ARTIFICIAL SEQUENCE
  Engineered IL-1R-I binding polypeptide
VDAKYAKEVEIAQMEIYELPNLTRKQYTAFIRKLLDDPSQSSELLSEAKKLNDSQAPK

SEQ ID NO: 804 - protein, 58 aa, ARTIFICIAL SEQUENCE
  Engineered IL-1R-I binding polypeptide
VDAKYAKELERAQMEIFGLPNLTRKQYTAFIRKLLDDPSQSSELLSEAKKLNDSQAPK

SEQ ID NO: 805 - protein, 58 aa, ARTIFICIAL SEQUENCE
  Engineered IL-1R-I binding polypeptide
VDAKYAKEVYAAYDEIYALPNLTRKQYTAFIRKLLDDPSQSSELLSEAKKLNDSQAPK

SEQ ID NO: 806 - protein, 58 aa, ARTIFICIAL SEQUENCE
  Engineered IL-1R-I binding polypeptide
VDAKYAKEAEFAQMEIFYLPNLTRRQYTAFIRKLLDDPSQSSELLSEAKKLNDSQAPK

SEQ ID NO: 807 - protein, 58 aa, ARTIFICIAL SEQUENCE
  Engineered IL-1R-I binding polypeptide
VDAKYAKEVQAAYYEIFALPNLTRKQYTAFIRKLLDDPSQSSELLSEAKKLNDSQAPK

SEQ ID NO: 808 - protein, 58 aa, ARTIFICIAL SEQUENCE
  Engineered IL-1R-I binding polypeptide
VDAKYAKEVYNAQMEIFYLPNLTRKQYTAFIRKLLDDPSQSSELLSEAKKLNDSQAPK

SEQ ID NO: 809 - protein, 58 aa, ARTIFICIAL SEQUENCE
  Engineered IL-1R-I binding polypeptide
VDAKYAKEAEIAQMEIYSLPNLTRKQYTAFIRKLLDDPSQSSELLSEAKKLNDSQAPK

SEQ ID NO: 810 - protein, 58 aa, ARTIFICIAL SEQUENCE
  Engineered IL-1R-I binding polypeptide
VDAKYAKEVEVAQMEIFDLPNLTRRQYTAFIRKLLDDPSQSSELLSEAKKLNDSQAPK

SEQ ID NO: 811 - protein, 58 aa, ARTIFICIAL SEQUENCE
  Engineered IL-1R-I binding polypeptide
VDAKYAKEVEQAQMEIYYLPNLTRKQYTAFIRKLFDDPSQSSELLSEAKKLNDSQAPK

SEQ ID NO: 812 - protein, 58 aa, ARTIFICIAL SEQUENCE
  Engineered IL-1R-I binding polypeptide
VDAKYAKEVENAQMEIFGLPNLTRKQYTAFIRKLLDDPSQSSELLSEAKKLNDSQAPK

SEQ ID NO: 813 - protein, 58 aa, ARTIFICIAL SEQUENCE
  Engineered IL-1R-I binding polypeptide
VDAKYAKEVEIAYIEIYKLPNLTRKQYTAFIRKLLDDPSQSSELLSEAKKLNDSQAPK

SEQ ID NO: 814 - protein, 58 aa, ARTIFICIAL SEQUENCE
  Engineered IL-1R-I binding polypeptide
VDAKYAKEVEVAQFEIFALPNLTRKQYTAFIRKLLDDPSQSSELLSEAKKLNDSQAPK

SEQ ID NO: 815 - protein, 58 aa, ARTIFICIAL SEQUENCE
  Engineered IL-1R-I binding polypeptide
VDAKYAKEIERAQMEIFYLPNLTRKQYTAFIRKLLDDPSQSSELLSEAKKLNDSQAPK

SEQ ID NO: 816 - protein, 58 aa, ARTIFICIAL SEQUENCE
  Engineered IL-1R-I binding polypeptide
VDAKYAKEIEDAQMEIFHLPNLTRKQYTAFIRKLLDDPSQSSELLSEAKKLNDSQAPK

SEQ ID NO: 817 - protein, 58 aa, ARTIFICIAL SEQUENCE
  Engineered IL-1R-I binding polypeptide
VDAKYAKEIENAQMEIFSLPNLTRKQYTAFIRKLLDDPSQSSELLSEAKKLNDSQAPK

SEQ ID NO: 818 - protein, 58 aa, ARTIFICIAL SEQUENCE
  Engineered IL-1R-I binding polypeptide
VDAKYAKELEAAQMEIFGLPNLTRKQYTAFIRKLLDDPSQSSELLSEAKKLNDSQAPK

SEQ ID NO: 819 - protein, 58 aa, ARTIFICIAL SEQUENCE
  Engineered IL-1R-I binding polypeptide
VDAKYAKEIERAQLEIFALPNLTRKQYTAFIRKLFDDPSQSSELLSEAKKLNDSQAPK

SEQ ID NO: 820 - protein, 58 aa, ARTIFICIAL SEQUENCE
  Engineered IL-1R-I binding polypeptide
VDAKYAKETYRAQMEIFALPNLTRRQYTAFIRKLLDDPSQSSELLSEAKKLNDSQAPK

SEQ ID NO: 821 - protein, 58 aa, ARTIFICIAL SEQUENCE
  Engineered IL-1R-I binding polypeptide
VDAKYAKEVEEAQMEIYSLPNLTRRQYTAFIRKLLDDPSQSSELLSEAKKLNDSQAPK

SEQ ID NO: 822 - protein, 58 aa, ARTIFICIAL SEQUENCE
  Engineered IL-1R-I binding polypeptide
VDAKYAKEVEKAQMEIFALPNLTRKQYTAFIRKLLDDPSQSSELLSEAKKLNDSQAPK

SEQ ID NO: 823 - protein, 58 aa, ARTIFICIAL SEQUENCE
  Engineered IL-1R-I binding polypeptide
VDAKYAKEAHAAYFEIYRLPNLTRKQYTAFIRKLLDDPSQSSELLSEAKKLNDSQAPK

SEQ ID NO: 824 - protein, 58 aa, ARTIFICIAL SEQUENCE
  Engineered IL-1R-I binding polypeptide
VDAKYAKEIERAQMEIYYLPNLTRKQYTAFIRKLLDDPSQSSELLSEAKKLNDSQAPK

SEQ ID NO: 825 - protein, 58 aa, ARTIFICIAL SEQUENCE
  Engineered IL-1R-I binding polypeptide
VDAKYAKELEAAQMEIFNLPNLTRKQYTAFIRKLLDDPSQSSELLSEAKKLNDSQAPK

SEQ ID NO: 826 - protein, 58 aa, ARTIFICIAL SEQUENCE
  Engineered IL-1R-I binding polypeptide
VDAKYAKEVEVAQMEIFALPNLTRKQYTAFIRKLFDDPSQSSELLSEAKKLNDSQAPK

SEQ ID NO: 827 - protein, 58 aa, ARTIFICIAL SEQUENCE
  Engineered IL-1R-I binding polypeptide
VDAKYAKEAEWAYMEIFKLPNLTRKQYTAFIRKLLDDPSQSSELLSEAKKLNDSQAPK

SEQ ID NO: 828 - protein, 58 aa, ARTIFICIAL SEQUENCE
  Engineered IL-1R-I binding polypeptide
VDAKYAKETEYAQLEIFALPNLTRKQYTAFIRKLLDDPSQSSELLSEAKKLNDSQAPK

SEQ ID NO: 829 - protein, 58 aa, ARTIFICIAL SEQUENCE
  Engineered IL-1R-I binding polypeptide
VDAKYAKEVEDAQMEIFRLPNLTRKQYTAFIRKLLDDPSQSSELLSEAKKLNDSQAPK

SEQ ID NO: 830 - protein, 58 aa, ARTIFICIAL SEQUENCE
  Engineered IL-1R-I binding polypeptide
VDAKYAKEIEEAQMEIFGLPNLTRKQYTAFIRKLFDDPSQSSELLSEAKKLNDSQAPK

SEQ ID NO: 831 - protein, 58 aa, ARTIFICIAL SEQUENCE
  Engineered IL-1R-I binding polypeptide
VDAKYAKEVERAQMEIFALPNLTRKQYTAFIRKLFDDPSQSSELLSEAKKLNDSQAPK

SEQ ID NO: 832 - protein, 58 aa, ARTIFICIAL SEQUENCE
  Engineered IL-1R-I binding polypeptide
VDAKYAKEAEAAYYEIYALPNLTRKQYTAFIRKLLDDPSQSSELLSEAKKLNDSQAPK

SEQ ID NO: 833 - protein, 58 aa, ARTIFICIAL SEQUENCE
  Engineered IL-1R-I binding polypeptide
VDAKYAKETEEAQMEIYRLPNLTRRQYTAFIRKLFDDPSQSSELLSEAKKLNDSQAPK

SEQ ID NO: 834 - protein, 58 aa, ARTIFICIAL SEQUENCE
  Engineered IL-1R-I binding polypeptide
VDAKYAKETEDAYFEIYRLPNLTRKQYTAFIRKLLDDPSQSSELLSEAKKLNDSQAPK

SEQ ID NO: 835 - protein, 58 aa, ARTIFICIAL SEQUENCE
  Engineered IL-1R-I binding polypeptide
VDAKYAKEIKQAQMEIYSLPNLTRKQYTAFIRKLFDDPSQSSELLSEAKKLNDSQAPK

SEQ ID NO: 836 - protein, 58 aa, ARTIFICIAL SEQUENCE
  Engineered IL-1R-I binding polypeptide
VDAKYAKEVEEAQMEIYNLPNLTRRQYTAFIRKLLDDPSQSSELLSEAKKLNDSQAPK

SEQ ID NO: 837 - protein, 58 aa, ARTIFICIAL SEQUENCE
  Engineered IL-1R-I binding polypeptide
VDAKYAKETEQAQMEIFGLPNLTRRQYTAFIRKLLDDPSQSSELLSEAKKLNDSQAPK

SEQ ID NO: 838 - protein, 58 aa, ARTIFICIAL SEQUENCE
  Engineered IL-1R-I binding polypeptide
VDAKYAKEIEDAQMEIYYLPNLTRKQYTAFIRKLFDDPSQSSELLSEAKKLNDSQAPK

SEQ ID NO: 839 - protein, 58 aa, ARTIFICIAL SEQUENCE
  Engineered IL-1R-I binding polypeptide
VDAKYAKESEQAYWEIYALPNLTRKQYTAFIRKLLDDPSQSSELLSEAKKLNDSQAPK

SEQ ID NO: 840 - protein, 58 aa, ARTIFICIAL SEQUENCE
  Engineered IL-1R-I binding polypeptide
VDAKYAKEVEVAQMEIYDLPNLTRKQYTAFIRKLLDDPSQSSELLSEAKKLNDSQAPK

SEQ ID NO: 841 - protein, 58 aa, ARTIFICIAL SEQUENCE
  Engineered IL-1R-I binding polypeptide
VDAKYAKEIERAQMEIFGLPNLTRKQYTAFIRKLLDDPSQSSELLSEAKKLNDSQAPK

SEQ ID NO: 842 - protein, 58 aa, ARTIFICIAL SEQUENCE
  Engineered IL-1R-I binding polypeptide
VDAKYAKEAEQAQMEIFGLPNLTRKQYTAFIRKLFDDPSQSSELLSEAKKLNDSQAPK

SEQ ID NO: 843 - protein, 58 aa, ARTIFICIAL SEQUENCE
  Engineered IL-1R-I binding polypeptide
VDAKYAKELEYAYFEIYNLPNLTRKQYTAFIRKLLDDPSQSSELLSEAKKLNDSQAPK

SEQ ID NO: 844 - protein, 58 aa, ARTIFICIAL SEQUENCE
  Engineered IL-1R-I binding polypeptide
VDAKYAKEVEFAQMEIFALPNLTRKQYTAFIRKLLDDPSQSSELLSEAKKLNDSQAPK

SEQ ID NO: 845 - protein, 58 aa, ARTIFICIAL SEQUENCE
  Engineered IL-1R-I binding polypeptide
VDAKYAKETEEAQMEIYNLPNLTRKQYTAFIRKLLDDPSQSSELLSEAKKLNDSQAPK

SEQ ID NO: 846 - protein, 58 aa, ARTIFICIAL SEQUENCE
  Engineered IL-1R-I binding polypeptide
VDAKYAKETYNAQMEIFALPNLTRKQYTAFIRKLLDDPSQSSELLSEAKKLNDSQAPK

SEQ ID NO: 847 - protein, 58 aa, ARTIFICIAL SEQUENCE
  Engineered IL-1R-I binding polypeptide
VDAKYAKEISVAQFEIYHLPNLTRKQYTAFIRKLFDDPSQSSELLSEAKKLNDSQAPK

SEQ ID NO: 848 - protein, 58 aa, ARTIFICIAL SEQUENCE
  Engineered IL-1R-I binding polypeptide
VDAKYAKEIKAAQMEIFELPNLTRKQYTAFIRKLLDDPSQSSELLSEAKKLNDSQAPK

SEQ ID NO: 849 - protein, 58 aa, ARTIFICIAL SEQUENCE
  Engineered IL-1R-I binding polypeptide
VDAKYAKEVEYAYQEIYALPNLTRKQYTAFIRKLLDDPSQSSELLSEAKKLNDSQAPK

SEQ ID NO: 850 - protein, 58 aa, ARTIFICIAL SEQUENCE
  Engineered IL-1R-I binding polypeptide
VDAKYAKEVEIAQMEIFELPNLTRKQYTAFIRKLFDDPSQSSELLSEAKKLNDSQAPK

SEQ ID NO: 851 - protein, 58 aa, ARTIFICIAL SEQUENCE
  Engineered IL-1R-I binding polypeptide
VDAKYAKEIDDAYLEIYALPNLTRKQYTAFIRKLLDDPSQSSELLSEAKKLNDSQAPK

SEQ ID NO: 852 - protein, 58 aa, ARTIFICIAL SEQUENCE
  Engineered IL-1R-I binding polypeptide
VDAKYAKEAYIAQQEIFALPNLTRKQYTAFIRKLLDDPSQSSELLSEAKKLNDSQAPK

SEQ ID NO: 853 - protein, 58 aa, ARTIFICIAL SEQUENCE
  Engineered IL-1R-I binding polypeptide
VDAKYAKEVEVAYFEIYALPNLTRKQYTAFIRKLLDDPSQSSELLSEAKKLNDSQAPK

SEQ ID NO: 854 - protein, 58 aa, ARTIFICIAL SEQUENCE
  Engineered IL-1R-I binding polypeptide
VDAKYAKEVVTAQMEIFFLPNLTRKQYTAFIRKLLDDPSQSSELLSEAKKLNDSQAPK

SEQ ID NO: 855 - protein, 58 aa, ARTIFICIAL SEQUENCE
  Engineered IL-1R-I binding polypeptide
VDAKYAKEVVIAQHEIFSLPNLTRRQYTAFIRKLLDDPSQSSELLSEAKKLNDSQAPK

SEQ ID NO: 856 - protein, 58 aa, ARTIFICIAL SEQUENCE
  Engineered IL-1R-I binding polypeptide
VDAKYAKEVEYAYYEIFKLPNLTRKQYTAFIRKLLDDPSQSSELLSEAKKLNDSQAPK

SEQ ID NO: 857 - protein, 58 aa, ARTIFICIAL SEQUENCE
  Engineered IL-1R-I binding polypeptide
VDAKYAKEAEAAQMEIFKLPNLTRKQYTAFIRKLLDDPSQSSELLSEAKKLNDSQAPK

SEQ ID NO: 858 - protein, 58 aa, ARTIFICIAL SEQUENCE
  Engineered IL-1R-I binding polypeptide
VDAKYAKELEKAYYEIYELPNLTRRQYTAFIRKLLDDPSQSSELLSEAKKLNDSQAPK

SEQ ID NO: 859 - protein, 58 aa, ARTIFICIAL SEQUENCE
  Engineered IL-1R-I binding polypeptide
VDAKYAKETHNAYQEIYQLPNLTRKQYTAFIRKLLDDPSQSSELLSEAKKLNDSQAPK

SEQ ID NO: 860 - protein, 58 aa, ARTIFICIAL SEQUENCE
  Engineered IL-1R-I binding polypeptide
VDAKYAKEVIEAYEEIFALPNLTRKQYTAFIRKLLDDPSQSSELLSEAKKLNDSQAPK

SEQ ID NO: 861 - protein, 58 aa, ARTIFICIAL SEQUENCE
  Engineered IL-1R-I binding polypeptide
VDAKYAKEVEAAYFEIFQLPNLTRKQYTAFIRKLLDDPSQSSELLSEAKKLNDSQAPK

SEQ ID NO: 862 - protein, 58 aa, ARTIFICIAL SEQUENCE
  Engineered IL-1R-I binding polypeptide
VDAKYAKEAEDAYHEIFSLPNLTRKQYTAFIRKLLDDPSQSSELLSEAKKLNDSQAPK

SEQ ID NO: 863 - protein, 58 aa, ARTIFICIAL SEQUENCE
  Engineered IL-1R-I binding polypeptide
VDAKYAKEVKDAQFEIFALPNLTRKQYTAFIRKLFDDPSQSSELLSEAKKLNDSQAPK

SEQ ID NO: 864 - protein, 58 aa, ARTIFICIAL SEQUENCE
  Engineered IL-1R-I binding polypeptide
VDAKYAKEADFAYWEIYALPNLTRKQYTAFIRKLLDDPSQSSELLSEAKKLNDSQAPK

SEQ ID NO: 865 - protein, 58 aa, ARTIFICIAL SEQUENCE
  Engineered IL-1R-I binding polypeptide
VDAKYAKEVQDAQMEIYYLPNLTRKQYTAFIRKLLDDPSQSSELLSEAKKLNDSQAPK

SEQ ID NO: 866 - protein, 58 aa, ARTIFICIAL SEQUENCE
  Engineered IL-1R-I binding polypeptide
VDAKYAKEAVQAYHEIFALPNLTRKQYTAFIRKLLDDPSQSSELLSEAKKLNDSQAPK

SEQ ID NO: 867 - protein, 58 aa, ARTIFICIAL SEQUENCE
  Engineered IL-1R-I binding polypeptide
VDAKYAKEATEAYDEIYLLPNLTRKQYTAFIRKLLDDPSQSSELLSEAKKLNDSQAPK

SEQ ID NO: 868 - protein, 58 aa, ARTIFICIAL SEQUENCE
  Engineered IL-1R-I binding polypeptide
VDAKYAKEATEAYMEIYSLPNLTRKQYTAFIRKLLDDPSQSSELLSEAKKLNDSQAPK

SEQ ID NO: 869 - protein, 58 aa, ARTIFICIAL SEQUENCE
  Engineered IL-1R-I binding polypeptide
VDAKYAKETESAYFEIYNLPNLTRKQYTAFIRKLLDDPSQSSELLSEAKKLNDSQAPK

SEQ ID NO: 870 - protein, 58 aa, ARTIFICIAL SEQUENCE
  Engineered IL-1R-I binding polypeptide
VDAKYAKEAEKAYMEIFGLPNLTRKQYTAFIRKLLDDPSQSSELLSEAKKLNDSQAPK

SEQ ID NO: 871 - protein, 58 aa, ARTIFICIAL SEQUENCE
  Engineered IL-1R-I binding polypeptide
VDAKYAKEVETAQMEIFSLPNLTRRQYTAFIRKLLDDPSQSSELLSEAKKLNDSQAPK

SEQ ID NO: 872 - protein, 58 aa, ARTIFICIAL SEQUENCE
  Engineered IL-1R-I binding polypeptide
VDAKYAKELYSAQMEIYGLPNLTRKQYTAFIRKLFDDPSQSSELLSEAKKLNDSQAPK

SEQ ID NO: 873 - protein, 58 aa, ARTIFICIAL SEQUENCE
  Engineered IL-1R-I binding polypeptide
VDAKYAKEAEEAYMEIFRLPNLTRKQYTAFIRKLLDDPSQSSELLSEAKKLNDSQAPK

SEQ ID NO: 874 - protein, 58 aa, ARTIFICIAL SEQUENCE
  Engineered IL-1R-I binding polypeptide
VDAKYAKEAQEAYDEIYGLPNLTRKQYTAFIRKLLDDPSQSSELLSEAKKLNDSQAPK

SEQ ID NO: 875 - protein, 58 aa, ARTIFICIAL SEQUENCE
  Engineered IL-1R-I binding polypeptide
VDAKYAKEHVEAYYEIYNLPNLTRRQYTAFIRKLLDDPSQSSELLSEAKKLNDSQAPK

SEQ ID NO: 876 - protein, 58 aa, ARTIFICIAL SEQUENCE
  Engineered IL-1R-I binding polypeptide
VDAKYAKETEQAQMEIFKLPNLTRKQYTAFIRKLLDDPSQSSELLSEAKKLNDSQAPK

SEQ ID NO: 877 - protein, 58 aa, ARTIFICIAL SEQUENCE
  Engineered IL-1R-I binding polypeptide
VDAKYAKEVEQAQMEIYNLPNLTRKQYTAFIRKLLDDPSQSSELLSEAKKLNDSQAPK

SEQ ID NO: 878 - protein, 58 aa, ARTIFICIAL SEQUENCE
  Engineered IL-1R-I binding polypeptide
VDAKYAKEATSAYFEIYALPNLTRRQYTAFIRKLLDDPSQSSELLSEAKKLNDSQAPK

SEQ ID NO: 879 - protein, 58 aa, ARTIFICIAL SEQUENCE
  Engineered IL-1R-I binding polypeptide
VDAKYAKELEAAQMEIFSLPNLTRKQYTAFIRKLLDDPSQSSELLSEAKKLNDSQAPK

SEQ ID NO: 880 - protein, 58 aa, ARTIFICIAL SEQUENCE
  Engineered IL-1R-I binding polypeptide
VDAKYAKEAEDAYMEIYRLPNLTRKQYTAFIRKLLDDPSQSSELLSEAKKLNDSQAPK

SEQ ID NO: 881 - protein, 58 aa, ARTIFICIAL SEQUENCE
  Engineered IL-1R-I binding polypeptide
VDAKYAKEAESAYMEIFRLPNLTRKQYTAFIRKLLDDPSQSSELLSEAKKLNDSQAPK

SEQ ID NO: 882 - protein, 58 aa, ARTIFICIAL SEQUENCE
  Engineered IL-1R-I binding polypeptide
VDAKYAKELEAAYFEIYYLPNLTRKQYTAFIRKLLDDPSQSSELLSEAKKLNDSQAPK

SEQ ID NO: 883 - protein, 58 aa, ARTIFICIAL SEQUENCE
  Engineered IL-1R-I binding polypeptide
VDAKYAKEAEYAYFEIYNLPNLTRKQYTAFIRKLLDDPSQSSELLSEAKKLNDSQAPK

SEQ ID NO: 884 - protein, 58 aa, ARTIFICIAL SEQUENCE
  Engineered IL-1R-I binding polypeptide
VDAKYAKETHSAQMEIFNLPNLTRKQYTAFIRKLLDDPSQSSELLSEAKKLNDSQAPK

SEQ ID NO: 885 - protein, 58 aa, ARTIFICIAL SEQUENCE
  Engineered IL-1R-I binding polypeptide
VDAKYAKETERAQMEIFDLPNLTRKQYTAFIRKLLDDPSQSSELLSEAKKLNDSQAPK

SEQ ID NO: 886 - protein, 58 aa, ARTIFICIAL SEQUENCE
  Engineered IL-1R-I binding polypeptide
VDAKYAKEAYSAQMEIFSLPNLTRKQYTAFIRKLLDDPSQSSELLSEAKKLNDSQAPK

SEQ ID NO: 887 - protein, 58 aa, ARTIFICIAL SEQUENCE
  Engineered IL-1R-I binding polypeptide
VDAKYAKEIEDAQMEIFGLPNLTRKQYTAFIRKLFDDPSQSSELLSEAKKLNDSQAPK

SEQ ID NO: 888 - protein, 58 aa, ARTIFICIAL SEQUENCE
  Engineered IL-1R-I binding polypeptide
VDAKYAKEVYSAQLEIFSLPNLTRKQYTAFIRKLFDDPSQSSELLSEAKKLNDSQAPK

SEQ ID NO: 889 - protein, 58 aa, ARTIFICIAL SEQUENCE
  Engineered IL-1R-I binding polypeptide
VDAKYAKEVEQAYYEIFYLPNLTRKQYTAFIRKLLDDPSQSSELLSEAKKLNDSQAPK

SEQ ID NO: 890 - protein, 58 aa, ARTIFICIAL SEQUENCE
  Engineered IL-1R-I binding polypeptide
VDAKYAKEIEEAYMEIFQLPNLTRKQYTAFIRKLLDDPSQSSELLSEAKKLNDSQAPK

SEQ ID NO: 891 - protein, 58 aa, ARTIFICIAL SEQUENCE
  Engineered IL-1R-I binding polypeptide
VDAKYAKEIEKAQMEIFALPNLTRKQYTAFIRKLFDDPSQSSELLSEAKKLNDSQAPK

SEQ ID NO: 892 - protein, 58 aa, ARTIFICIAL SEQUENCE
  Engineered IL-1R-I binding polypeptide
VDAKYAKEAVVAYSEIYGLPNLTRKQYTAFIRKLLDDPSQSSELLSEAKKLNDSQAPK

SEQ ID NO: 893 - protein, 58 aa, ARTIFICIAL SEQUENCE
  Engineered IL-1R-I binding polypeptide
VDAKYAKEIEVAYSEIYNLPNLTRKQYTAFIRKLLDDPSQSSELLSEAKKLNDSQAPK

SEQ ID NO: 894 - protein, 58 aa, ARTIFICIAL SEQUENCE
  Engineered IL-1R-I binding polypeptide
VDAKYAKEVDEAYMEIYELPNLTRRQYTAFIRKLLDDPSQSSELLSEAKKLNDSQAPK

SEQ ID NO: 895 - protein, 58 aa, ARTIFICIAL SEQUENCE
  Engineered IL-1R-I binding polypeptide
VDAKYAKEIEHAQMEIFYLPNLTRKQYTAFIRKLFDDPSQSSELLSEAKKLNDSQAPK

SEQ ID NO: 896 - protein, 58 aa, ARTIFICIAL SEQUENCE
  Engineered IL-1R-I binding polypeptide
VDAKYAKELSDAYFEIYALPNLTRKQYTAFIRKLLDDPSQSSELLSEAKKLNDSQAPK

SEQ ID NO: 897 - protein, 58 aa, ARTIFICIAL SEQUENCE
  Engineered IL-1R-I binding polypeptide
VDAKYAKEVEEAQMEIFVLPNLTRKQYTAFIRKLLDDPSQSSELLSEAKKLNDSQAPK

SEQ ID NO: 898 - protein, 58 aa, ARTIFICIAL SEQUENCE
  Engineered IL-1R-I binding polypeptide
VDAKYAKELEEAYMEIYHLPNLTRKQYTAFIRKLLDDPSQSSELLSEAKKLNDSQAPK

SEQ ID NO: 899 - protein, 58 aa, ARTIFICIAL SEQUENCE
  Engineered IL-1R-I binding polypeptide
VDAKYAKEVELAYFEIFRLPNLTRKQYTAFIRKLLDDPSQSSELLSEAKKLNDSQAPK

SEQ ID NO: 900 - protein, 58 aa, ARTIFICIAL SEQUENCE
  Engineered IL-1R-I binding polypeptide
VDAKYAKETVSAYWEIFELPNLTRKQYTAFIRKLLDDPSQSSELLSEAKKLNDSQAPK

SEQ ID NO: 901 - protein, 58 aa, ARTIFICIAL SEQUENCE
  Engineered IL-1R-I binding polypeptide
VDAKYAKEIKEAQMEIYYLPNLTRKQYTAFIRKLLDDPSQSSELLSEAKKLNDSQAPK

SEQ ID NO: 902 - protein, 58 aa, ARTIFICIAL SEQUENCE
  Engineered IL-1R-I binding polypeptide
VDAKYAKELEEAQMEIFKLPNLTRKQYTAFIRKLLDDPSQSSELLSEAKKLNDSQAPK

SEQ ID NO: 903 - protein, 58 aa, ARTIFICIAL SEQUENCE
  Engineered IL-1R-I binding polypeptide
VDAKYAKEIEDAYMEIYRLPNLTRKQYTAFIRKLLDDPSQSSELLSEAKKLNDSQAPK

SEQ ID NO: 904 - protein, 58 aa, ARTIFICIAL SEQUENCE
  Engineered IL-1R-I binding polypeptide
VDAKYAKEVEIAYFEIYNLPNLTRKQYTAFIRKLLDDPSQSSELLSEAKKLNDSQAPK

SEQ ID NO: 905 - protein, 58 aa, ARTIFICIAL SEQUENCE
  Engineered IL-1R-I binding polypeptide
VDAKYAKEAESAYWEIYALPNLTRKQYTAFIRKLLDDPSQSSELLSEAKKLNDSQAPK

SEQ ID NO: 906 - protein, 58 aa, ARTIFICIAL SEQUENCE
  Engineered IL-1R-I binding polypeptide
VDAKYAKEVEAAYMEIYHLPNLTRKQYTAFIRKLLDDPSQSSELLSEAKKLNDSQAPK

SEQ ID NO: 907 - protein, 58 aa, ARTIFICIAL SEQUENCE
  Engineered IL-1R-I binding polypeptide
VDAKYAKEAVDAYWEIYGLPNLTRKQYTAFIRKLLDDPSQSSELLSEAKKLNDSQAPK

SEQ ID NO: 908 - protein, 58 aa, ARTIFICIAL SEQUENCE
  Engineered IL-1R-I binding polypeptide
VDAKYAKEVEIAYFEIYALPNLTRKQYTAFIRKLLDDPSQSSELLSEAKKLNDSQAPK

SEQ ID NO: 909 - protein, 58 aa, ARTIFICIAL SEQUENCE
  Engineered IL-1R-I binding polypeptide
VDAKYAKEVINAYFEIYHLPNLTRKQYTAFIRKLLDDPSQSSELLSEAKKLNDSQAPK

SEQ ID NO: 910 - protein, 58 aa, ARTIFICIAL SEQUENCE
  Engineered IL-1R-I binding polypeptide
VDAKYAKEVEEAYMEIFQLPNLTRKQYTAFIRKLLDDPSQSSELLSEAKKLNDSQAPK

SEQ ID NO: 911 - protein, 58 aa, ARTIFICIAL SEQUENCE
  Engineered IL-1R-I binding polypeptide
VDAKYAKEVEAAYFEIYDLPNLTRKQYTAFIRKLLDDPSQSSELLSEAKKLNDSQAPK

SEQ ID NO: 912 - protein, 58 aa, ARTIFICIAL SEQUENCE
  Engineered IL-1R-I binding polypeptide
VDAKYAKEVEDAYFEIYHLPNLTRKQYTAFIRKLLDDPSQSSELLSEAKKLNDSQAPK

SEQ ID NO: 913 - protein, 58 aa, ARTIFICIAL SEQUENCE
  Engineered IL-1R-I binding polypeptide
VDAKYAKEIEDAYMEIYYLPNLTRKQYTAFIRKLLDDPSQSSELLSEAKKLNDSQAPK

SEQ ID NO: 914 - protein, 58 aa, ARTIFICIAL SEQUENCE
  Engineered IL-1R-I binding polypeptide
VDAKYAKEVEDAQMEIFNLPNLTRKQYTAFIRKLLDDPSQSSELLSEAKKLNDSQAPK

SEQ ID NO: 915 - protein, 58 aa, ARTIFICIAL SEQUENCE
  Engineered IL-1R-I binding polypeptide
VDAKYAKEVEDAYMEIFHLPNLTRKQYTAFIRKLLDDPSQSSELLSEAKKLNDSQAPK

SEQ ID NO: 916 - protein, 58 aa, ARTIFICIAL SEQUENCE
  Engineered IL-1R-I binding polypeptide
VDAKYAKEQESAYWEIYALPNLTRKQYTAFIRKLLDDPSQSSELLSEAKKLNDSQAPK

SEQ ID NO: 917 - protein, 58 aa, ARTIFICIAL SEQUENCE
  Engineered IL-1R-I binding polypeptide
VDAKYAKETEEAYQEIYQLPNLTRKQYTAFIRKLLDDPSQSSELLSEAKKLNDSQAPK

SEQ ID NO: 918 - protein, 58 aa, ARTIFICIAL SEQUENCE
  Engineered IL-1R-I binding polypeptide
VDAKYAKEELEAYWEIFALPNLTRKQYTAFIRKLLDDPSQSSELLSEAKKLNDSQAPK

SEQ ID NO: 919 - protein, 58 aa, ARTIFICIAL SEQUENCE
  Engineered IL-1R-I binding polypeptide
VDAKYAKEVQDAYWEIYALPNLTRKQYTAFIRKLLDDPSQSSELLSEAKKLNDSQAPK

SEQ ID NO: 920 - protein, 58 aa, ARTIFICIAL SEQUENCE
  Engineered IL-1R-I binding polypeptide
VDAKYAKEVENAYFEIFALPNLTRKQYTAFIRKLLDDPSQSSELLSEAKKLNDSQAPK

SEQ ID NO: 921 - protein, 58 aa, ARTIFICIAL SEQUENCE
  Engineered IL-1R-I binding polypeptide
VDAKYAKEVEAAYYEIYGLPNLTRKQYTAFIRKLLDDPSQSSELLSEAKKLNDSQAPK

SEQ ID NO: 922 - protein, 58 aa, ARTIFICIAL SEQUENCE
  Engineered IL-1R-I binding polypeptide
VDAKYAKEVEHAYFEIYHLPNLTRKQYTAFIRKLLDDPSQSSELLSEAKKLNDSQAPK

SEQ ID NO: 923 - protein, 58 aa, ARTIFICIAL SEQUENCE
  Engineered IL-1R-I binding polypeptide
VDAKYAKEVHEAYMEIFELPNLTRKQYTAFIRKLLDDPSQSSELLSEAKKLNDSQAPK

SEQ ID NO: 924 - protein, 58 aa, ARTIFICIAL SEQUENCE
  Engineered IL-1R-I binding polypeptide
VDAKYAKEVEQAYMEIYALPNLTRKQYTAFIRKLLDDPSQSSELLSEAKKLNDSQAPK

SEQ ID NO: 925 - protein, 58 aa, ARTIFICIAL SEQUENCE
  Engineered IL-1R-I binding polypeptide
VDAKYAKEVVDAYYEIYDLPNLTRKQYTAFIRKLLDDPSQSSELLSEAKKLNDSQAPK

SEQ ID NO: 926 - protein, 58 aa, ARTIFICIAL SEQUENCE
  Engineered IL-1R-I binding polypeptide
VDAKYAKEAQIAYFEIYSLPNLTRKQYTAFIRKLLDDPSQSSELLSEAKKLNDSQAPK

SEQ ID NO: 927 - protein, 58 aa, ARTIFICIAL SEQUENCE
  Engineered IL-1R-I binding polypeptide
VDAKYAKEVEFAYYEIYRLPNLTRKQYTAFIRKLLDDPSQSSELLSEAKKLNDSQAPK

SEQ ID NO: 928 - protein, 58 aa, ARTIFICIAL SEQUENCE
  Engineered IL-1R-I binding polypeptide
VDAKYAKEVVEAYYEIYDLPNLTRKQYTAFIRKLLDDPSQSSELLSEAKKLNDSQAPK

SEQ ID NO: 929 - protein, 58 aa, ARTIFICIAL SEQUENCE
  Engineered IL-1R-I binding polypeptide
VDAKYAKEIEEAYMEIYELPNLTRKQYTAFIRKLLDDPSQSSELLSEAKKLNDSQAPK

SEQ ID NO: 930 - protein, 58 aa, ARTIFICIAL SEQUENCE
  Engineered IL-1R-I binding polypeptide
VDAKYAKEVQTAYMEIYHLPNLTRKQYTAFIRKLLDDPSQSSELLSEAKKLNDSQAPK

SEQ ID NO: 931 - protein, 58 aa, ARTIFICIAL SEQUENCE
  Engineered IL-1R-I binding polypeptide
VDAKYAKEAEYAYFEIYKLPNLTRKQYTAFIRKLLDDPSQSSELLSEAKKLNDSQAPK

SEQ ID NO: 932 - protein, 58 aa, ARTIFICIAL SEQUENCE
  Engineered IL-1R-I binding polypeptide
VDAKYAKEAYIAQMEIFELPNLTRKQYTAFIRKLLDDPSQSSELLSEAKKLNDSQAPK

SEQ ID NO: 933 - protein, 58 aa, ARTIFICIAL SEQUENCE
  Engineered IL-1R-I binding polypeptide
VDAKYAKEAERAYWEIYELPNLTRKQYTAFIRKLLDDPSQSSELLSEAKKLNDSQAPK

SEQ ID NO: 934 - protein, 58 aa, ARTIFICIAL SEQUENCE
  Engineered IL-1R-I binding polypeptide
VDAKYAKETHDAYYEIYGLPNLTRKQYTAFIRKLLDDPSQSSELLSEAKKLNDSQAPK

SEQ ID NO: 935 - protein, 58 aa, ARTIFICIAL SEQUENCE
  Engineered IL-1R-I binding polypeptide
VDAKYAKELEDAYYEIFGLPNLTRKQYTAFIRKLLDDPSQSSELLSEAKKLNDSQAPK

SEQ ID NO: 936 - protein, 58 aa, ARTIFICIAL SEQUENCE
  Engineered IL-1R-I binding polypeptide
VDAKYAKEVEDAYQEIFQLPNLTRKQYTAFIRKLLDDPSQSSELLSEAKKLNDSQAPK

SEQ ID NO: 937 - protein, 58 aa, ARTIFICIAL SEQUENCE
  Engineered IL-1R-I binding polypeptide
VDAKYAKEAHNAYYEIYALPNLTRKQYTAFIRKLLDDPSQSSELLSEAKKLNDSQAPK

SEQ ID NO: 938 - protein, 58 aa, ARTIFICIAL SEQUENCE
  Engineered IL-1R-I binding polypeptide
VDAKYAKEVEDAYFEIYWLPNLTRKQYTAFIRKLLDDPSQSSELLSEAKKLNDSQAPK

SEQ ID NO: 939 - protein, 58 aa, ARTIFICIAL SEQUENCE
  Engineered IL-1R-I binding polypeptide
VDAKYAKEVTEAYFEIYRLPNLTRKQYTAFIRKLLDDPSQSSELLSEAKKLNDSQAPK

SEQ ID NO: 940 - protein, 58 aa, ARTIFICIAL SEQUENCE
  Engineered IL-1R-I binding polypeptide
VDAKYAKEVEKAYEEIYKLPNLTRKQYTAFIRKLLDDPSQSSELLSEAKKLNDSQAPK

SEQ ID NO: 941 - protein, 58 aa, ARTIFICIAL SEQUENCE
  Engineered IL-1R-I binding polypeptide
VDAKYAKEVDYAYFEIYKLPNLTRKQYTAFIRKLLDDPSQSSELLSEAKKLNDSQAPK

SEQ ID NO: 942 - protein, 58 aa, ARTIFICIAL SEQUENCE
  Engineered IL-1R-I binding polypeptide
VDAKYAKETEAAYFEIFHLPNLTRKQYTAFIRKLLDDPSQSSELLSEAKKLNDSQAPK

SEQ ID NO: 943 - protein, 58 aa, ARTIFICIAL SEQUENCE
  Engineered IL-1R-I binding polypeptide
VDAKYAKEVEVAYMEIFQLPNLTRKQYTAFIRKLLDDPSQSSELLSEAKKLNDSQAPK

SEQ ID NO: 944 - protein, 58 aa, ARTIFICIAL SEQUENCE
  Engineered IL-1R-I binding polypeptide
VDAKYAKEVEQAYMEIFGLPNLTRKQYTAFIRKLLDDPSQSSELLSEAKKLNDSQAPK

SEQ ID NO: 945 - protein, 58 aa, ARTIFICIAL SEQUENCE
  Engineered IL-1R-I binding polypeptide
VDAKYAKEVEYAYFEIYGLPNLTRKQYTAFIRKLLDDPSQSSELLSEAKKLNDSQAPK

SEQ ID NO: 946 - protein, 58 aa, ARTIFICIAL SEQUENCE
  Engineered IL-1R-I binding polypeptide
VDAKYAKEAEVAYWEIYALPNLTRKQYTAFIRKLLDDPSQSSELLSEAKKLNDSQAPK

SEQ ID NO: 947 - protein, 58 aa, ARTIFICIAL SEQUENCE
  Engineered IL-1R-I binding polypeptide
VDAKYAKEVEIAYYEIYRLPNLTRKQYTAFIRKLLDDPSQSSELLSEAKKLNDSQAPK

SEQ ID NO: 948 - protein, 58 aa, ARTIFICIAL SEQUENCE
  Engineered IL-1R-I binding polypeptide
VDAKYAKEVIQAYFEIYELPNLTRKQYTAFIRKLLDDPSQSSELLSEAKKLNDSQAPK

SEQ ID NO: 949 - protein, 58 aa, ARTIFICIAL SEQUENCE
  Engineered IL-1R-I binding polypeptide
VDAKYAKEAEDAYWEIFKLPNLTRKQYTAFIRKLLDDPSQSSELLSEAKKLNDSQAPK

SEQ ID NO: 950 - protein, 58 aa, ARTIFICIAL SEQUENCE
  Engineered IL-1R-I binding polypeptide
VDAKYAKEVTEAYFEIYALPNLTRKQYTAFIRKLLDDPSQSSELLSEAKKLNDSQAPK

SEQ ID NO: 951 - protein, 58 aa, ARTIFICIAL SEQUENCE
  Engineered IL-1R-I binding polypeptide
VDAKYAKEVEEAYFEIYRLPNLTRKQYTAFIRKLLDDPSQSSELLSEAKKLNDSQAPK

SEQ ID NO: 952 - protein, 58 aa, ARTIFICIAL SEQUENCE
  Engineered IL-1R-I binding polypeptide
VDAKYAKEVQEAYFEIFGLPNLTRKQYTAFIRKLLDDPSQSSELLSEAKKLNDSQAPK

SEQ ID NO: 953 - protein, 58 aa, ARTIFICIAL SEQUENCE
  Engineered IL-1R-I binding polypeptide
VDAKYAKEVVEAYEEIYALPNLTRKQYTAFIRKLLDDPSQSSELLSEAKKLNDSQAPK

SEQ ID NO: 954 - protein, 58 aa, ARTIFICIAL SEQUENCE
  Engineered IL-1R-I binding polypeptide
VDAKYAKEVQVAYFEIFALPNLTRKQYTAFIRKLLDDPSQSSELLSEAKKLNDSQAPK

SEQ ID NO: 955 - protein, 58 aa, ARTIFICIAL SEQUENCE
  Engineered IL-1R-I binding polypeptide
VDAKYAKEVEDAYIEIYELPNLTRKQYTAFIRKLLDDPSQSSELLSEAKKLNDSQAPK

SEQ ID NO: 956 - protein, 58 aa, ARTIFICIAL SEQUENCE
  Engineered IL-1R-I binding polypeptide
VDAKYAKEVEAAYYEIYELPNLTRKQYTAFIRKLLDDPSQSSELLSEAKKLNDSQAPK

SEQ ID NO: 957 - protein, 58 aa, ARTIFICIAL SEQUENCE
  Engineered IL-1R-I binding polypeptide
VDAKYAKEVEIAYDEIYRLPNLTRKQYTAFIRKLLDDPSQSSELLSEAKKLNDSQAPK

SEQ ID NO: 958 - protein, 58 aa, ARTIFICIAL SEQUENCE
  Engineered IL-1R-I binding polypeptide
VDAKYAKEHEEAYWEIYALPNLTRKQYTAFIRKLLDDPSQSSELLSEAKKLNDSQAPK

SEQ ID NO: 959 - protein, 58 aa, ARTIFICIAL SEQUENCE
  Engineered IL-1R-I binding polypeptide
VDAKYAKEVYLAQMEIFSLPNLTRKQYTAFIRKLLDDPSQSSELLSEAKKLNDSQAPK

SEQ ID NO: 960 - protein, 58 aa, ARTIFICIAL SEQUENCE
  Engineered IL-1R-I binding polypeptide
VDAKYAKETEKAQMEIFQLPNLTRKQYTAFIRKLLDDPSQSSELLSEAKKLNDSQAPK

SEQ ID NO: 961 - protein, 58 aa, ARTIFICIAL SEQUENCE
  Engineered IL-1R-I binding polypeptide
VDAKYAKELEEAYMEIYALPNLTRKQYTAFIRKLLDDPSQSSELLSEAKKLNDSQAPK

SEQ ID NO: 962 - protein, 58 aa, ARTIFICIAL SEQUENCE
  Engineered IL-1R-I binding polypeptide
VDAKYAKEVYEAYDEIYNLPNLTRKQYTAFIRKLLDDPSQSSELLSEAKKLNDSQAPK

SEQ ID NO: 963 - protein, 58 aa, ARTIFICIAL SEQUENCE
  Engineered IL-1R-I binding polypeptide
VDAKYAKETIEAYEEIYELPNLTRKQYTAFIRKLLDDPSQSSELLSEAKKLNDSQAPK

SEQ ID NO: 964 - protein, 58 aa, ARTIFICIAL SEQUENCE
  Engineered IL-1R-I binding polypeptide
VDAKYAKEHIEAYDEIFKLPNLTRKQYTAFIRKLLDDPSQSSELLSEAKKLNDSQAPK

SEQ ID NO: 965 - protein, 58 aa, ARTIFICIAL SEQUENCE
  Engineered IL-1R-I binding polypeptide
VDAKYAKEAQLAYWEIYGLPNLTRKQYTAFIRKLLDDPSQSSELLSEAKKLNDSQAPK

SEQ ID NO: 966 - protein, 58 aa, ARTIFICIAL SEQUENCE
  Engineered IL-1R-I binding polypeptide
VDAKYAKEVFDAQMEIFSLPNLTRKQYTAFIRKLLDDPSQSSELLSEAKKLNDSQAPK

SEQ ID NO: 967 - protein, 58 aa, ARTIFICIAL SEQUENCE
  Engineered IL-1R-I binding polypeptide
VDAKYAKEIEEAQMEIYYLPNLTRKQYTAFIRKLLDDPSQSSELLSEAKKLNDSQAPK

SEQ ID NO: 968 - protein, 58 aa, ARTIFICIAL SEQUENCE
  Engineered IL-1R-I binding polypeptide
VDAKYAKEVEKAYFEIFKLPNLTRKQYTAFIRKLLDDPSQSSELLSEAKKLNDSQAPK

SEQ ID NO: 969 - protein, 58 aa, ARTIFICIAL SEQUENCE
  Engineered IL-1R-I binding polypeptide
VDAKYAKEVEVAYYEIYGLPNLTRKQYTAFIRKLLDDPSQSSELLSEAKKLNDSQAPK

SEQ ID NO: 970 - protein, 58 aa, ARTIFICIAL SEQUENCE
  Engineered IL-1R-I binding polypeptide
VDAKYAKEVEYAYFEIYNLPNLTRKQYTAFIRKLLDDPSQSSELLSEAKKLNDSQAPK

SEQ ID NO: 971 - protein, 58 aa, ARTIFICIAL SEQUENCE
  Engineered IL-1R-I binding polypeptide
VDAKYAKEVIAAYYEIYELPNLTRKQYTAFIRKLLDDPSQSSELLSEAKKLNDSQAPK

SEQ ID NO: 972 - protein, 58 aa, ARTIFICIAL SEQUENCE
  Engineered IL-1R-I binding polypeptide
VDAKYAKEVVDAYMEIYGLPNLTRKQYTAFIRKLLDDPSQSSELLSEAKKLNDSQAPK

SEQ ID NO: 973 - protein, 58 aa, ARTIFICIAL SEQUENCE
  Engineered IL-1R-I binding polypeptide
VDAKYAKEAETAYFEIYALPNLTRKQYTAFIRKLLDDPSQSSELLSEAKKLNDSQAPK

SEQ ID NO: 974 - protein, 58 aa, ARTIFICIAL SEQUENCE
  Engineered IL-1R-I binding polypeptide
VDAKYAKEVEEAQMEIYRLPNLTRKQYTAFIRKLLDDPSQSSELLSEAKKLNDSQAPK

SEQ ID NO: 975 - protein, 58 aa, ARTIFICIAL SEQUENCE
  Engineered IL-1R-I binding polypeptide
VDAKYAKEAEAAYFEIFALPNLTRKQYTAFIRKLLDDPSQSSELLSEAKKLNDSQAPK

SEQ ID NO: 976 - protein, 58 aa, ARTIFICIAL SEQUENCE
  Engineered IL-1R-I binding polypeptide
VDAKYAKEVEAAQMEIFDLPNLTRRQYTAFIRKLLDDPSQSSELLSEAKKLNDSQAPK

SEQ ID NO: 977 - protein, 58 aa, ARTIFICIAL SEQUENCE
  Engineered IL-1R-I binding polypeptide
VDAKYAKELEWAYFEIYALPNLTRKQYTAFIRKLLDDPSQSSELLSEAKKLNDSQAPK

SEQ ID NO: 978 - protein, 58 aa, ARTIFICIAL SEQUENCE
  Engineered IL-1R-I binding polypeptide
VDAKYAKEQKQAYWEIYALPNLTRKQYTAFIRKLLDDPSQSSELLSEAKKLNDSQAPK

SEQ ID NO: 979 - protein, 58 aa, ARTIFICIAL SEQUENCE
  Engineered IL-1R-I binding polypeptide
VDAKYAKEAEDAYYEIYALPNLTRKQYTAFIRKLLDDPSQSSELLSEAKKLNDSQAPK

SEQ ID NO: 980 - protein, 58 aa, ARTIFICIAL SEQUENCE
  Engineered IL-1R-I binding polypeptide
VDAKYAKEQHEAYWEIYRLPNLTRKQYTAFIRKLLDDPSQSSELLSEAKKLNDSQAPK

SEQ ID NO: 981 - protein, 58 aa, ARTIFICIAL SEQUENCE
  Engineered IL-1R-I binding polypeptide
VDAKYAKEVEDAYMEIFGLPNLTRKQYTAFIRKLLDDPSQSSELLSEAKKLNDSQAPK

SEQ ID NO: 982 - protein, 58 aa, ARTIFICIAL SEQUENCE
  Engineered IL-1R-I binding polypeptide
VDAKYAKEVDHAYFEIYRLPNLTRKQYTAFIRKLLDDPSQSSELLSEAKKLNDSQAPK

SEQ ID NO: 983 - protein, 58 aa, ARTIFICIAL SEQUENCE
  Engineered IL-1R-I binding polypeptide
VDAKYAKEAIEAYDEIFLLPNLTRKQYTAFIRKLLDDPSQSSELLSEAKKLNDSQAPK

SEQ ID NO: 984 - protein, 58 aa, ARTIFICIAL SEQUENCE
  Engineered IL-1R-I binding polypeptide
VDAKYAKEVVEAYWEIYALPNLTRKQYTAFIRKLLDDPSQSSELLSEAKKLNDSQAPK

SEQ ID NO: 985 - protein, 58 aa, ARTIFICIAL SEQUENCE
  Engineered IL-1R-I binding polypeptide
VDAKYAKETEDAQMEIFSLPNLTRKQYTAFIRKLLDDPSQSSELLSEAKKLNDSQAPK

SEQ ID NO: 986 - protein, 58 aa, ARTIFICIAL SEQUENCE
  Engineered IL-1R-I binding polypeptide
VDAKYAKEVIDAYYEIYELPNLTRKQYTAFIRKLLDDPSQSSELLSEAKKLNDSQAPK

SEQ ID NO: 987 - protein, 58 aa, ARTIFICIAL SEQUENCE
  Engineered IL-1R-I binding polypeptide
VDAKYAKEAIDAYHEIFALPNLTRKQYTAFIRKLLDDPSQSSELLSEAKKLNDSQAPK

SEQ ID NO: 988 - protein, 58 aa, ARTIFICIAL SEQUENCE
  Engineered IL-1R-I binding polypeptide
VDAKYAKETHDAYMEIYHLPNLTRKQYTAFIRKLLDDPSQSSELLSEAKKLNDSQAPK

SEQ ID NO: 989 - protein, 58 aa, ARTIFICIAL SEQUENCE
  Engineered IL-1R-I binding polypeptide
VDAKYAKEIESAYMEIFYLPNLTRKQYTAFIRKLLDDPSQSSELLSEAKKLNDSQAPK

SEQ ID NO: 990 - protein, 58 aa, ARTIFICIAL SEQUENCE
  Engineered IL-1R-I binding polypeptide
VDAKYAKEIEKAYMEIYHLPNLTRRQYTAFIRKLLDDPSQSSELLSEAKKLNDSQAPK

SEQ ID NO: 991 - protein, 58 aa, ARTIFICIAL SEQUENCE
  Engineered IL-1R-I binding polypeptide
VDAKYAKEAEDAYQEIFQLPNLTRKQYTAFIRKLLDDPSQSSELLSEAKKLNDSQAPK

SEQ ID NO: 992 - protein, 58 aa, ARTIFICIAL SEQUENCE
  Engineered IL-1R-I binding polypeptide
VDAKYAKEVEEAYMEIFALPNLTRKQYTAFIRKLLDDPSQSSELLSEAKKLNDSQAPK

SEQ ID NO: 993 - protein, 58 aa, ARTIFICIAL SEQUENCE
  Engineered IL-1R-I binding polypeptide
VDAKYAKEVEDAQMEIFELPNLTRRQYTAFIRKLLDDPSQSSELLSEAKKLNDSQAPK

SEQ ID NO: 994 - protein, 58 aa, ARTIFICIAL SEQUENCE
  Engineered IL-1R-I binding polypeptide
VDAKYAKEVENAQYEIYGLPNLTRKQYTAFIRKLLDDPSQSSELLSEAKKLNDSQAPK

SEQ ID NO: 995 - protein, 58 aa, ARTIFICIAL SEQUENCE
  Engineered IL-1R-I binding polypeptide
VDAKYAKEVEVAYMEIYALPNLTRKQYTAFIRKLLDDPSQSSELLSEAKKLNDSQAPK

SEQ ID NO: 996 - protein, 58 aa, ARTIFICIAL SEQUENCE
  Engineered IL-1R-I binding polypeptide
VDAKYAKESEQAYWEIFHLPNLTRKQYTAFIRKLLDDPSQSSELLSEAKKLNDSQAPK

SEQ ID NO: 997 - protein, 58 aa, ARTIFICIAL SEQUENCE
  Engineered IL-1R-I binding polypeptide
VDAKYAKETVDAYEEIFTLPNLTRKQYTAFIRKLLDDPSQSSELLSEAKKLNDSQAPK

SEQ ID NO: 998 - protein, 58 aa, ARTIFICIAL SEQUENCE
  Engineered IL-1R-I binding polypeptide
VDAKYAKEIEEAYMEIYHLPNLTRKQYTAFIRKLLDDPSQSSELLSEAKKLNDSQAPK

SEQ ID NO: 999 - protein, 58 aa, ARTIFICIAL SEQUENCE
  Engineered IL-1R-I binding polypeptide
VDAKYAKEVVVAYEEIFKLPNLTRKQYTAFIRKLLDDPSQSSELLSEAKKLNDSQAPK

SEQ ID NO: 1000 - protein, 58 aa, ARTIFICIAL SEQUENCE
  Engineered IL-1R-I binding polypeptide
VDAKYAKEAVNAYWEIYALPNLTRKQYTAFIRKLLDDPSQSSELLSEAKKLNDSQAPK

SEQ ID NO: 1001 - protein, 58 aa, ARTIFICIAL SEQUENCE
  Engineered IL-1R-I binding polypeptide
VDAKYAKESEKAYMEIFALPNLTRKQYTAFIRKLLDDPSQSSELLSEAKKLNDSQAPK

SEQ ID NO: 1002 - protein, 58 aa, ARTIFICIAL SEQUENCE
  Engineered IL-1R-I binding polypeptide
VDAKYAKEVEEAYFEIYLLPNLTRKQYTAFIRKLLDDPSQSSELLSEAKKLNDSQAPK

SEQ ID NO: 1003 - protein, 58 aa, ARTIFICIAL SEQUENCE
  Engineered IL-1R-I binding polypeptide
VDAKYAKEIEAAQMEIFGLPNLTRRQYTAFIRKLLDDPSQSSELLSEAKKLNDSQAPK

SEQ ID NO: 1004 - protein, 58 aa, ARTIFICIAL SEQUENCE
  Engineered IL-1R-I binding polypeptide
VDAKYAKEQEKAYFEIYALPNLTRKQYTAFIRKLLDDPSQSSELLSEAKKLNDSQAPK

SEQ ID NO: 1005 - protein, 58 aa, ARTIFICIAL SEQUENCE
  Engineered IL-1R-I binding polypeptide
VDAKYAKEVEIAYYEIFALPNLTRRQYTAFIRKLLDDPSQSSELLSEAKKLNDSQAPK

SEQ ID NO: 1006 - protein, 58 aa, ARTIFICIAL SEQUENCE
  Engineered IL-1R-I binding polypeptide
VDAKYAKEVYAAYEEIFGLPNLTRKQYTAFIRKLLDDPSQSSELLSEAKKLNDSQAPK

SEQ ID NO: 1007 - protein, 58 aa, ARTIFICIAL SEQUENCE
  Engineered IL-1R-I binding polypeptide
VDAKYAKEVESAQMEIFGLPNLTRKQYTAFIRKLLDDPSQSSELLSEAKKLNDSQAPK

SEQ ID NO: 1008 - protein, 58 aa, ARTIFICIAL SEQUENCE
  Engineered IL-1R-I binding polypeptide
VDAKYAKELEVAYMEIYELPNLTRKQYTAFIRKLLDDPSQSSELLSEAKKLNDSQAPK

SEQ ID NO: 1009 - protein, 58 aa, ARTIFICIAL SEQUENCE
  Engineered IL-1R-I binding polypeptide
VDAKYAKETINAYWEIYALPNLTRKQYTAFIRKLLDDPSQSSELLSEAKKLNDSQAPK

SEQ ID NO: 1010 - protein, 58 aa, ARTIFICIAL SEQUENCE
  Engineered IL-1R-I binding polypeptide
VDAKYAKEAETAYWEIYKLPNLTRKQYTAFIRKLLDDPSQSSELLSEAKKLNDSQAPK

SEQ ID NO: 1011 - protein, 58 aa, ARTIFICIAL SEQUENCE
  Engineered IL-1R-I binding polypeptide
VDAKYAKETEAAYWEIFALPNLTRKQYTAFIRKLLDDPSQSSELLSEAKKLNDSQAPK

SEQ ID NO: 1012 - protein, 58 aa, ARTIFICIAL SEQUENCE
  Engineered IL-1R-I binding polypeptide
VDAKYAKELQKAYMEIYELPNLTRKQYTAFIRKLLDDPSQSSELLSEAKKLNDSQAPK

SEQ ID NO: 1013 - protein, 58 aa, ARTIFICIAL SEQUENCE
  Engineered IL-1R-I binding polypeptide
VDAKYAKELEVAYFEIYDLPNLTRKQYTAFIRKLLDDPSQSSELLSEAKKLNDSQAPK

SEQ ID NO: 1014 - protein, 58 aa, ARTIFICIAL SEQUENCE
  Engineered IL-1R-I binding polypeptide
VDAKYAKEVEYAYWEIFALPNLTRKQYTAFIRKLLDDPSQSSELLSEAKKLNDSQAPK

SEQ ID NO: 1015 - protein, 58 aa, ARTIFICIAL SEQUENCE
  Engineered IL-1R-I binding polypeptide
VDAKYAKETEEAYFEIYGLPNLTRKQYTAFIRKLLDDPSQSSELLSEAKKLNDSQAPK

SEQ ID NO: 1016 - protein, 58 aa, ARTIFICIAL SEQUENCE
  Engineered IL-1R-I binding polypeptide
VDAKYAKELESAYMEIYGLPNLTRKQYTAFIRKLLDDPSQSSELLSEAKKLNDSQAPK

SEQ ID NO: 1017 - protein, 58 aa, ARTIFICIAL SEQUENCE
  Engineered IL-1R-I binding polypeptide
VDAKYAKEVEVAYMEIFGLPNLTRKQYTAFIRKLLDDPSQSSELLSEAKKLNDSQAPK

SEQ ID NO: 1018 - protein, 58 aa, ARTIFICIAL SEQUENCE
  Engineered IL-1R-I binding polypeptide
VDAKYAKEVEDAYMEIYELPNLTRRQYTAFIRKLLDDPSQSSELLSEAKKLNDSQAPK

SEQ ID NO: 1019 - protein, 58 aa, ARTIFICIAL SEQUENCE
  Engineered IL-1R-I binding polypeptide
VDAKYAKEHVDAYYEIYGLPNLTRKQYTAFIRKLLDDPSQSSELLSEAKKLNDSQAPK

SEQ ID NO: 1020 - protein, 58 aa, ARTIFICIAL SEQUENCE
  Engineered IL-1R-I binding polypeptide
VDAKYAKEHERAYFEIYALPNLTRKQYTAFIRKLLDDPSQSSELLSEAKKLNDSQAPK

SEQ ID NO: 1021 - protein, 58 aa, ARTIFICIAL SEQUENCE
  Engineered IL-1R-I binding polypeptide
VDAKYAKEATEAYWEIYALPNLTRKQYTAFIRKLLDDPSQSSELLSEAKKLNDSQAPK

SEQ ID NO: 1022 - protein, 58 aa, ARTIFICIAL SEQUENCE
  Engineered IL-1R-I binding polypeptide
VDAKYAKEVYKAQMEIFGLPNLTRKQYTAFIRKLLDDPSQSSELLSEAKKLNDSQAPK

SEQ ID NO: 1023 - protein, 58 aa, ARTIFICIAL SEQUENCE
  Engineered IL-1R-I binding polypeptide
VDAKYAKEVERAYMEIFRLPNLTRKQYTAFIRKLLDDPSQSSELLSEAKKLNDSQAPK

SEQ ID NO: 1024 - protein, 58 aa, ARTIFICIAL SEQUENCE
  Engineered IL-1R-I binding polypeptide
VDAKYAKELEHAQLEIFRLPNLTRKQYTAFIRKLLDDPSQSSELLSEAKKLNDSQAPK

SEQ ID NO: 1025 - protein, 58 aa, ARTIFICIAL SEQUENCE
  Engineered IL-1R-I binding polypeptide
VDAKYAKEAQAAYDEIYGLPNLTRKQYTAFIRKLLDDPSQSSELLSEAKKLNDSQAPK

SEQ ID NO: 1026 - protein, 58 aa, ARTIFICIAL SEQUENCE
  Engineered IL-1R-I binding polypeptide
VDAKYAKEVEEAQMEIYELPNLTRKQYTAFIRKLLDDPSQSSELLSEAKKLNDSQAPK

SEQ ID NO: 1027 - protein, 58 aa, ARTIFICIAL SEQUENCE
  Engineered IL-1R-I binding polypeptide
VDAKYAKEVEEAYMEIFHLPNLTRKQYTAFIRKLLDDPSQSSELLSEAKKLNDSQAPK

SEQ ID NO: 1028 - protein, 58 aa, ARTIFICIAL SEQUENCE
  Engineered IL-1R-I binding polypeptide
VDAKYAKEVEHAYFEIYGLPNLTRKQYTAFIRKLLDDPSQSSELLSEAKKLNDSQAPK

SEQ ID NO: 1029 - protein, 58 aa, ARTIFICIAL SEQUENCE
  Engineered IL-1R-I binding polypeptide
VDAKYAKEVESAQMEIYYLPNLTRKQYTAFIRKLLDDPSQSSELLSEAKKLNDSQAPK

SEQ ID NO: 1030 - protein, 58 aa, ARTIFICIAL SEQUENCE
  Engineered IL-1R-I binding polypeptide
VDAKYAKEVEKAQMEIFYLPNLTRKQYTAFIRKLLDDPSQSSELLSEAKKLNDSQAPK

SEQ ID NO: 1031 - protein, 58 aa, ARTIFICIAL SEQUENCE
  Engineered IL-1R-I binding polypeptide
VDAKYAKEVDEAYMEIFKLPNLTRKQYTAFIRKLLDDPSQSSELLSEAKKLNDSQAPK

SEQ ID NO: 1032 - protein, 58 aa, ARTIFICIAL SEQUENCE
  Engineered IL-1R-I binding polypeptide
VDAKYAKETEEAYMEIYHLPNLTRKQYTAFIRKLLDDPSQSSELLSEAKKLNDSQAPK

SEQ ID NO: 1033 - protein, 58 aa, ARTIFICIAL SEQUENCE
  Engineered IL-1R-I binding polypeptide
VDAKYAKEAEAAYFEIYGLPNLTRKQYTAFIRKLLDDPSQSSELLSEAKKLNDSQAPK

SEQ ID NO: 1034 - protein, 58 aa, ARTIFICIAL SEQUENCE
  Engineered IL-1R-I binding polypeptide
VDAKYAKELEDAYMEIYHLPNLTRKQYTAFIRKLLDDPSQSSELLSEAKKLNDSQAPK

SEQ ID NO: 1035 - protein, 58 aa, ARTIFICIAL SEQUENCE
  Engineered IL-1R-I binding polypeptide
VDAKYAKEVEVAYEEIYELPNLTRKQYTAFIRKLLDDPSQSSELLSEAKKLNDSQAPK

SEQ ID NO: 1036 - protein, 58 aa, ARTIFICIAL SEQUENCE
  Engineered IL-1R-I binding polypeptide
VDAKYAKEAVEAYWEIYGLPNLTRKQYTAFIRKLLDDPSQSSELLSEAKKLNDSQAPK

SEQ ID NO: 1037 - protein, 58 aa, ARTIFICIAL SEQUENCE
  Engineered IL-1R-I binding polypeptide
VDAKYAKELEEAYMEIYFLPNLTRKQYTAFIRKLLDDPSQSSELLSEAKKLNDSQAPK

SEQ ID NO: 1038 - protein, 58 aa, ARTIFICIAL SEQUENCE
  Engineered IL-1R-I binding polypeptide
VDAKYAKEVENAYMEIYELPNLTRKQYTAFIRKLLDDPSQSSELLSEAKKLNDSQAPK

SEQ ID NO: 1039 - protein, 58 aa, ARTIFICIAL SEQUENCE
  Engineered IL-1R-I binding polypeptide
VDAKYAKETVKAYEEIYKLPNLTRKQYTAFIRKLLDDPSQSSELLSEAKKLNDSQAPK

SEQ ID NO: 1040 - protein, 58 aa, ARTIFICIAL SEQUENCE
  Engineered IL-1R-I binding polypeptide
VDAKYAKELEKAQMEIFSLPNLTRKQYTAFIRKLLDDPSQSSELLSEAKKLNDSQAPK

SEQ ID NO: 1041 - protein, 58 aa, ARTIFICIAL SEQUENCE
  Engineered IL-1R-I binding polypeptide
VDAKYAKETEKAQLEIFELPNLTRKQYTAFIRKLLDDPSQSSELLSEAKKLNDSQAPK

SEQ ID NO: 1042 - protein, 58 aa, ARTIFICIAL SEQUENCE
  Engineered IL-1R-I binding polypeptide
VDAKYAKEVELAYMEIFHLPNLTRKQYTAFIRKLLDDPSQSSELLSEAKKLNDSQAPK

SEQ ID NO: 1043 - protein, 58 aa, ARTIFICIAL SEQUENCE
  Engineered IL-1R-I binding polypeptide
VDAKYAKEAENAYWEIYELPNLTRRQYTAFIRKLLDDPSQSSELLSEAKKLNDSQAPK

SEQ ID NO: 1044 - protein, 58 aa, ARTIFICIAL SEQUENCE
  Engineered IL-1R-I binding polypeptide
VDAKYAKEVIQAYWEIYHLPNLTRKQYTAFIRKLLDDPSQSSELLSEAKKLNDSQAPK

SEQ ID NO: 1045 - protein, 58 aa, ARTIFICIAL SEQUENCE
  Engineered IL-1R-I binding polypeptide
VDAKYAKEAEYAYMEIFRLPNLTRKQYTAFIRKLLDDPSQSSELLSEAKKLNDSQAPK

SEQ ID NO: 1046 - protein, 58 aa, ARTIFICIAL SEQUENCE
  Engineered IL-1R-I binding polypeptide
VDAKYAKEVESAYMEIYHLPNLTRKQYTAFIRKLLDDPSQSSELLSEAKKLNDSQAPK

SEQ ID NO: 1047 - protein, 58 aa, ARTIFICIAL SEQUENCE
  Engineered IL-1R-I binding polypeptide
VDAKYAKETEDAYMEIFRLPNLTRKQYTAFIRKLLDDPSQSSELLSEAKKLNDSQAPK

SEQ ID NO: 1048 - protein, 58 aa, ARTIFICIAL SEQUENCE
  Engineered IL-1R-I binding polypeptide
VDAKYAKEVDAAYFEIFNLPNLTRKQYTAFIRKLLDDPSQSSELLSEAKKLNDSQAPK

SEQ ID NO: 1049 - protein, 58 aa, ARTIFICIAL SEQUENCE
  Engineered IL-1R-I binding polypeptide
VDAKYAKEAEDAYFEIYSLPNLTRKQYTAFIRKLLDDPSQSSELLSEAKKLNDSQAPK

SEQ ID NO: 1050 - protein, 58 aa, ARTIFICIAL SEQUENCE
  Engineered IL-1R-I binding polypeptide
VDAKYAKELEDAYMEIFGLPNLTRKQYTAFIRKLLDDPSQSSELLSEAKKLNDSQAPK

SEQ ID NO: 1051 - protein, 58 aa, ARTIFICIAL SEQUENCE
  Engineered IL-1R-I binding polypeptide
VDAKYAKEVEAAYFEIYGLPNLTRKQYTAFIRKLLDDPSQSSELLSEAKKLNDSQAPK

SEQ ID NO: 1052 - protein, 58 aa, ARTIFICIAL SEQUENCE
  Engineered IL-1R-I binding polypeptide
VDAKYAKEVEFAYYEIFALPNLTRKQYTAFIRKLLDDPSQSSELLSEAKKLNDSQAPK

SEQ ID NO: 1053 - protein, 58 aa, ARTIFICIAL SEQUENCE
  Engineered IL-1R-I binding polypeptide
VDAKYAKEVVSAYWEIYALPNLTRRQYTAFIRKLLDDPSQSSELLSEAKKLNDSQAPK

SEQ ID NO: 1054 - protein, 58 aa, ARTIFICIAL SEQUENCE
  Engineered IL-1R-I binding polypeptide
VDAKYAKETEKAYFEIYALPNLTRKQYTAFIRKLLDDPSQSSELLSEAKKLNDSQAPK

SEQ ID NO: 1055 - protein, 58 aa, ARTIFICIAL SEQUENCE
  Engineered IL-1R-I binding polypeptide
VDAKYAKEAEYAYMEIYNLPNLTRKQYTAFIRKLLDDPSQSSELLSEAKKLNDSQAPK

SEQ ID NO: 1056 - protein, 58 aa, ARTIFICIAL SEQUENCE
  Engineered IL-1R-I binding polypeptide
VDAKYAKEVESAYMEIYRLPNLTRKQYTAFIRKLLDDPSQSSELLSEAKKLNDSQAPK

SEQ ID NO: 1057 - protein, 58 aa, ARTIFICIAL SEQUENCE
  Engineered IL-1R-I binding polypeptide
VDAKYAKEVEVAYMEIYGLPNLTRKQYTAFIRKLLDDPSQSSELLSEAKKLNDSQAPK

SEQ ID NO: 1058 - protein, 58 aa, ARTIFICIAL SEQUENCE
  Engineered IL-1R-I binding polypeptide
VDAKYAKEIEFAYMEIFHLPNLTRKQYTAFIRKLLDDPSQSSELLSEAKKLNDSQAPK

SEQ ID NO: 1059 - protein, 58 aa, ARTIFICIAL SEQUENCE
  Engineered IL-1R-I binding polypeptide
VDAKYAKEVVEAYFEIYELPNLTRKQYTAFIRKLLDDPSQSSELLSEAKKLNDSQAPK

SEQ ID NO: 1060 - protein, 58 aa, ARTIFICIAL SEQUENCE
  Engineered IL-1R-I binding polypeptide
VDAKYAKEIEAAQMEIFALPNLTRKQYTAFIRKLFDDPSQSSELLSEAKKLNDSQAPK

SEQ ID NO: 1061 - protein, 58 aa, ARTIFICIAL SEQUENCE
  Engineered IL-1R-I binding polypeptide
VDAKYAKEVEDAQMEIFGLPNLTRKQYTAFIRKLFDDPSQSSELLSEAKKLNDSQAPK

SEQ ID NO: 1062 - protein, 58 aa, ARTIFICIAL SEQUENCE
  Engineered IL-1R-I binding polypeptide
VDAKYAKEIEEAQMEIYGLPNLTRKQYTAFIRKLLDDPSQSSELLSEAKKLNDSQAPK

SEQ ID NO: 1063 - protein, 58 aa, ARTIFICIAL SEQUENCE
  Engineered IL-1R-I binding polypeptide
VDAKYAKETLDAQMEIFALPNLTRKQYTAFIRKLLDDPSQSSELLSEAKKLNDSQAPK

SEQ ID NO: 1064 - protein, 58 aa, ARTIFICIAL SEQUENCE
  Engineered IL-1R-I binding polypeptide
VDAKYAKETQEAQMEIFALPNLTRKQYTAFIRKLLDDPSQSSELLSEAKKLNDSQAPK

SEQ ID NO: 1065 - protein, 58 aa, ARTIFICIAL SEQUENCE
  Engineered IL-1R-I binding polypeptide
VDAKYAKEVEEAQMEIFALPNLTRKQYTAFIRKLFDDPSQSSELLSEAKKLNDSQAPK

SEQ ID NO: 1066 - protein, 58 aa, ARTIFICIAL SEQUENCE
  Engineered IL-1R-I binding polypeptide
VDAKYAKEVEDAQMEIFALPNLTRKQYTAFIRKLFDDPSQSSELLSEAKKLNDSQAPK

SEQ ID NO: 1067 - protein, 58 aa, ARTIFICIAL SEQUENCE
  Engineered IL-1R-I binding polypeptide
VDAKYAKEVESAQMEIFYLPNLTRKQYTAFIRKLFDDPSQSSELLSEAKKLNDSQAPK

SEQ ID NO: 1068 - protein, 58 aa, ARTIFICIAL SEQUENCE
  Engineered IL-1R-I binding polypeptide
VDAKYAKEIEDAQMEIFALPNLTRKQYTAFIRKLLDDPSQSSELLSEAKKLNDSQAPK

SEQ ID NO: 1069 - protein, 58 aa, ARTIFICIAL SEQUENCE
  Engineered IL-1R-I binding polypeptide
VDAKYAKEVEAAQMEIFFLPNLTRRQYTAFIRKLLDDPSQSSELLSEAKKLNDSQAPK

SEQ ID NO: 1070 - protein, 58 aa, ARTIFICIAL SEQUENCE
  Engineered IL-1R-I binding polypeptide
VDAKYAKEVEEAQLEIFALPNLTRKQYTAFIIKLFDDPSQSSELLSEAKKLNDSQAPK

SEQ ID NO: 1071 - protein, 58 aa, ARTIFICIAL SEQUENCE
  Engineered IL-1R-I binding polypeptide
VDAKYAKETEDAQMEIFALPNLTRKQYTAFIRKLLDDPSQSSELLSEAKKLNDSQAPK

SEQ ID NO: 1072 - protein, 58 aa, ARTIFICIAL SEQUENCE
  Engineered IL-1R-I binding polypeptide
VDAKYAKEIEIAQMEIFRLPNLTRKQYTAFIRKLFDDPSQSSELLSEAKKLNDSQAPK

SEQ ID NO: 1073 - protein, 58 aa, ARTIFICIAL SEQUENCE
  Engineered IL-1R-I binding polypeptide
VDAKYAKEVEIAQMEIFALPNLTRKQYTAFIRKLFDDPSQSSELLSEAKKLNDSQAPK

SEQ ID NO: 1074 - protein, 58 aa, ARTIFICIAL SEQUENCE
  Engineered IL-1R-I binding polypeptide
VDAKYAKEIEIAQMEIFSLPNLTRKQYTAFIRKLFDDPSQSSELLSEAKKLNDSQAPK

SEQ ID NO: 1075 - protein, 58 aa, ARTIFICIAL SEQUENCE
  Engineered IL-1R-I binding polypeptide
VDAKYAKETEAAQMEIFYLPNLTRKQYTAFIRKLLDDPSQSSELLSEAKKLNDSQAPK

SEQ ID NO: 1076 - protein, 58 aa, ARTIFICIAL SEQUENCE
  Engineered IL-1R-I binding polypeptide
VDAKYAKEIEDAQMEIFALPNLTRKQYTAFIRKLFDDPSQSSELLSEAKKLNDSQAPK

SEQ ID NO: 1077 - protein, 58 aa, ARTIFICIAL SEQUENCE
  Engineered IL-1R-I binding polypeptide
VDAKYAKEVEHAQMEIFDLPNLTRKQYTAFIRKLLDDPSQSSELLSEAKKLNDSQAPK

SEQ ID NO: 1078 - protein, 58 aa, ARTIFICIAL SEQUENCE
  Engineered IL-1R-I binding polypeptide
VDAKYAKEVVSAQMEIFGLPNLTRRQYTAFIRKLLDDPSQSSELLSEAKKLNDSQAPK

SEQ ID NO: 1079 - protein, 58 aa, ARTIFICIAL SEQUENCE
  Engineered IL-1R-I binding polypeptide
VDAKYAKELDEAYFEIYGLPNLTRKQYTAFIRKLLDDPSQSSELLSEAKKLNDSQAPK

SEQ ID NO: 1080 - protein, 58 aa, ARTIFICIAL SEQUENCE
  Engineered IL-1R-I binding polypeptide
VDAKYAKEVEHAQLEIFRLPNLTRRQYTAFIRKLLDDPSQSSELLSEAKKLNDSQAPK

SEQ ID NO: 1081 - protein, 58 aa, ARTIFICIAL SEQUENCE
  Engineered IL-1R-I binding polypeptide
VDAKYAKEAYKAQMEIFGLPNLTRKQYTAFIRKLLDDPSQSSELLSEAKKLNDSQAPK

SEQ ID NO: 1082 - protein, 58 aa, ARTIFICIAL SEQUENCE
  Engineered IL-1R-I binding polypeptide
VDAKYAKEIELAQMEIFFLPNLTRKQYTAFIRKLFDDPSQSSELLSEAKKLNDSQAPK

SEQ ID NO: 1083 - protein, 58 aa, ARTIFICIAL SEQUENCE
  Engineered IL-1R-I binding polypeptide
VDAKYAKEVEHAQMEIFTLPNLTRKQYTAFIRKLLDDPSQSSELLSEAKKLNDSQAPK

SEQ ID NO: 1084 - protein, 58 aa, ARTIFICIAL SEQUENCE
  Engineered IL-1R-I binding polypeptide
VDAKYAKEVKIAQMEIYELPNLTRKQYTAFIRKLLDDPSQSSELLSEAKKLNDSQAPK

SEQ ID NO: 1085 - protein, 58 aa, ARTIFICIAL SEQUENCE
  Engineered IL-1R-I binding polypeptide
VDAKYAKEAEDAYQEIFGLPNLTRKQYTAFIRKLLDDPSQSSELLSEAKKLNDSQAPK

SEQ ID NO: 1086 - protein, 58 aa, ARTIFICIAL SEQUENCE
  Engineered IL-1R-I binding polypeptide
VDAKYAKEAENAYDEIYKLPNLTRKQYTAFIRKLLDDPSQSSELLSEAKKLNDSQAPK

SEQ ID NO: 1087 - protein, 58 aa, ARTIFICIAL SEQUENCE
  Engineered IL-1R-I binding polypeptide
VDAKYAKEIEAAQIEIFHLPNLTRKQYTAFIRKLFDDPSQSSELLSEAKKLNDSQAPK

SEQ ID NO: 1088 - protein, 58 aa, ARTIFICIAL SEQUENCE
  Engineered IL-1R-I binding polypeptide
VDAKYAKEVVDAQQEIFNLPNLTRKQYTAFIRKLFDDPSQSSELLSEAKKLNDSQAPK

SEQ ID NO: 1089 - protein, 58 aa, ARTIFICIAL SEQUENCE
  Engineered IL-1R-I binding polypeptide
VDAKYAKEIEWAQMEIFALPNLTRKQYTAFIRKLLDDPSQSSELLSEAKKLNDSQAPK

SEQ ID NO: 1090 - protein, 58 aa, ARTIFICIAL SEQUENCE
  Engineered IL-1R-I binding polypeptide
VDAKYAKEIEDAQMEIYELPNLTRKQYTAFIRKLFDDPSQSSELLSEAKKLNDSQAPK

SEQ ID NO: 1091 - protein, 58 aa, ARTIFICIAL SEQUENCE
  Engineered IL-1R-I binding polypeptide
VDAKYAKEAEKAQIEIFYLPNLTRRQYTAFIRKLLDDPSQSSELLSEAKKLNDSQAPK

SEQ ID NO: 1092 - protein, 58 aa, ARTIFICIAL SEQUENCE
  Engineered IL-1R-I binding polypeptide
VDAKYAKEAEWAQMEIYSLPNLTRKQYTAFIRKLFDDPSQSSELLSEAKKLNDSQAPK

SEQ ID NO: 1093 - protein, 58 aa, ARTIFICIAL SEQUENCE
  Engineered IL-1R-I binding polypeptide
VDAKYAKEVEAAYMEIFQLPNLTRKQYTAFIRKLLDDPSQSSELLSEAKKLNDSQAPK

SEQ ID NO: 1094 - protein, 58 aa, ARTIFICIAL SEQUENCE
  Engineered IL-1R-I binding polypeptide
VDAKYAKEVEIAQMEIYSLPNLTRRQYTAFIRKLLDDPSQSSELLSEAKKLNDSQAPK

SEQ ID NO: 1095 - protein, 58 aa, ARTIFICIAL SEQUENCE
  Engineered IL-1R-I binding polypeptide
VDAKYAKEIKAAQMEIFALPNLTRKQYTAFIRKLLDDPSQSSELLSEAKKLNDSQAPK

SEQ ID NO: 1096 - protein, 58 aa, ARTIFICIAL SEQUENCE
  Engineered IL-1R-I binding polypeptide
VDAKYAKEVEYAQMEIFNLPNLTRKQYTAFIRKLFDDPSQSSELLSEAKKLNDSQAPK

SEQ ID NO: 1097 - protein, 58 aa, ARTIFICIAL SEQUENCE
  Engineered IL-1R-I binding polypeptide
VDAKYAKEVYAAQQEIFHLPNLTRKQYTAFIRKLFDDPSQSSELLSEAKKLNDSQAPK

SEQ ID NO: 1098 - protein, 58 aa, ARTIFICIAL SEQUENCE
  Engineered IL-1R-I binding polypeptide
VDAKYAKEAEQAYMEIFRLPNLTRKQYTAFIRKLLDDPSQSSELLSEAKKLNDSQAPK

SEQ ID NO: 1099 - protein, 58 aa, ARTIFICIAL SEQUENCE
  Engineered IL-1R-I binding polypeptide
VDAKYAKEVDVAYQEIFNLPNLTRKQYTAFIRKLLDDPSQSSELLSEAKKLNDSQAPK

SEQ ID NO: 1100 - protein, 58 aa, ARTIFICIAL SEQUENCE
  Engineered IL-1R-I binding polypeptide
VDAKYAKEVYHAQMEIFSLPNLTRKQYTAFIRKLFDDPSQSSELLSEAKKLNDSQAPK

SEQ ID NO: 1101 - protein, 58 aa, ARTIFICIAL SEQUENCE
  Engineered IL-1R-I binding polypeptide
VDAKYAKEAEDAQMEIYALPNLTRKQYTAFIRKLLDDPSQSSELLSEAKKLNDSQAPK

SEQ ID NO: 1102 - protein, 58 aa, ARTIFICIAL SEQUENCE
  Engineered IL-1R-I binding polypeptide
VDAKYAKEVQEAQMEIFELPNLTRKQYTAFIRKLLDDPSQSSELLSEAKKLNDSQAPK

SEQ ID NO: 1103 - protein, 58 aa, ARTIFICIAL SEQUENCE
  Engineered IL-1R-I binding polypeptide
VDAKYAKEHEFAYMEIYHLPNLTRKQYTAFIRKLLDDPSQSSELLSEAKKLNDSQAPK

SEQ ID NO: 1104 - protein, 58 aa, ARTIFICIAL SEQUENCE
  Engineered IL-1R-I binding polypeptide
VDAKYAKEAEEAYVEIFKLPNLTRKQYTAFIRKLLDDPSQSSELLSEAKKLNDSQAPK

SEQ ID NO: 1105 - protein, 58 aa, ARTIFICIAL SEQUENCE
  Engineered IL-1R-I binding polypeptide
VDAKYAKEIEKAQFEIYYLPNLTRKQYTAFIRKLLDDPSQSSELLSEAKKLNDSQAPK

SEQ ID NO: 1106 - protein, 58 aa, ARTIFICIAL SEQUENCE
  Engineered IL-1R-I binding polypeptide
VDAKYAKEVYKAQMEIFALPNLTRKQYTAFIRKLFDDPSQSSELLSEAKKLNDSQAPK

SEQ ID NO: 1107 - protein, 58 aa, ARTIFICIAL SEQUENCE
  Engineered IL-1R-I binding polypeptide
VDAKYAKEVEKAQMEIYYLPNLTRKQYTAFIRKLLDDPSQSSELLSEAKKLNDSQAPK

SEQ ID NO: 1108 - protein, 58 aa, ARTIFICIAL SEQUENCE
  Engineered IL-1R-I binding polypeptide
VDAKYAKEVEAAQLEIFELPNLTRKQYTAFIRKLLDDPSQSSELLSEAKKLNDSQAPK

SEQ ID NO: 1109 - protein, 58 aa, ARTIFICIAL SEQUENCE
  Engineered IL-1R-I binding polypeptide
VDAKYAKETYQAQMEIYSLPNLTRKQYTAFIRKLLDDPSQSSELLSEAKKLNDSQAPK

SEQ ID NO: 1110 - protein, 58 aa, ARTIFICIAL SEQUENCE
  Engineered IL-1R-I binding polypeptide
VDAKYAKELEDAYQEIFHLPNLTRKQYTAFIRKLLDDPSQSSELLSEAKKLNDSQAPK

SEQ ID NO: 1111 - protein, 58 aa, ARTIFICIAL SEQUENCE
  Engineered IL-1R-I binding polypeptide
VDAKYAKEVEEAQLEIFSLPNLTRKQYTAFIRKLLDDPSQSSELLSEAKKLNDSQAPK

SEQ ID NO: 1112 - protein, 58 aa, ARTIFICIAL SEQUENCE
  Engineered IL-1R-I binding polypeptide
VDAKYAKEIYLAQMEIFKLPNLTRRQYTAFIRKLLDDPSQSSELLSEAKKLNDSQAPK

SEQ ID NO: 1113 - protein, 58 aa, ARTIFICIAL SEQUENCE
  Engineered IL-1R-I binding polypeptide
VDAKYAKEIEEAQMEIFKLPNLTRKQYTAFIRKLLDDPSQSSELLSEAKKLNDSQAPK

SEQ ID NO: 1114 - protein, 58 aa, ARTIFICIAL SEQUENCE
  Engineered IL-1R-I binding polypeptide
VDAKYAKETEQAYMEIYQLPNLTRKQYTAFIRKLLDDPSQSSELLSEAKKLNDSQAPK

SEQ ID NO: 1115 - protein, 58 aa, ARTIFICIAL SEQUENCE
  Engineered IL-1R-I binding polypeptide
VDAKYAKEAEAAYYEIYHLPNLTRKQYTAFIRKLLDDPSQSSELLSEAKKLNDSQAPK

SEQ ID NO: 1116 - protein, 58 aa, ARTIFICIAL SEQUENCE
  Engineered IL-1R-I binding polypeptide
VDAKYAKETEAAYDEIYGLPNLTRKQYTAFIRKLLDDPSQSSELLSEAKKLNDSQAPK

SEQ ID NO: 1117 - protein, 58 aa, ARTIFICIAL SEQUENCE
  Engineered IL-1R-I binding polypeptide
VDAKYAKEVEEAYFEIFRLPNLTRKQYTAFIRKLLDDPSQSSELLSEAKKLNDSQAPK

SEQ ID NO: 1118 - protein, 58 aa, ARTIFICIAL SEQUENCE
  Engineered IL-1R-I binding polypeptide
VDAKYAKEVVKAYFEIYHLPNLTRRQYTAFIRKLLDDPSQSSELLSEAKKLNDSQAPK

SEQ ID NO: 1119 - protein, 58 aa, ARTIFICIAL SEQUENCE
  Engineered IL-1R-I binding polypeptide
VDAKYAKEVYEAQMEIFKLPNLTRKQYTAFIRKLLDDPSQSSELLSEAKKLNDSQAPK

SEQ ID NO: 1120 - protein, 58 aa, ARTIFICIAL SEQUENCE
  Engineered IL-1R-I binding polypeptide
VDAKYAKEVEDAYIEIYKLPNLTRKQYTAFIRKLLDDPSQSSELLSEAKKLNDSQAPK

SEQ ID NO: 1121 - protein, 58 aa, ARTIFICIAL SEQUENCE
  Engineered IL-1R-I binding polypeptide
VDAKYAKEVEWAQMEIFNLPNLTRRQYTAFIRKLLDDPSQSSELLSEAKKLNDSQAPK

SEQ ID NO: 1122 - protein, 58 aa, ARTIFICIAL SEQUENCE
  Engineered IL-1R-I binding polypeptide
VDAKYAKELEKAQMEIFYLPNLTRKQYTAFIRKLFDDPSQSSELLSEAKKLNDSQAPK

SEQ ID NO: 1123 - protein, 58 aa, ARTIFICIAL SEQUENCE
  Engineered IL-1R-I binding polypeptide
VDAKYAKETEEAYQEIFHLPNLTRKQYTAFIRKLLDDPSQSSELLSEAKKLNDSQAPK

SEQ ID NO: 1124 - protein, 58 aa, ARTIFICIAL SEQUENCE
  Engineered IL-1R-I binding polypeptide
VDAKYAKEAEDAQMEIFKLPNLTRKQYTAFIRKLLDDPSQSSELLSEAKKLNDSQAPK

SEQ ID NO: 1125 - protein, 58 aa, ARTIFICIAL SEQUENCE
  Engineered IL-1R-I binding polypeptide
VDAKYAKEIEEAQLEIFNLPNLTRKQYTAFIRKLLDDPSQSSELLSEAKKLNDSQAPK

SEQ ID NO: 1126 - protein, 58 aa, ARTIFICIAL SEQUENCE
  Engineered IL-1R-I binding polypeptide
VDAKYAKEVEDAYHEIFLLPNLTRKQYTAFIRKLLDDPSQSSELLSEAKKLNDSQAPK

SEQ ID NO: 1127 - protein, 58 aa, ARTIFICIAL SEQUENCE
  Engineered IL-1R-I binding polypeptide
VDAKYAKEVEYAYHEIFKLPNLTRKQYTAFIRKLLDDPSQSSELLSEAKKLNDSQAPK

SEQ ID NO: 1128 - protein, 58 aa, ARTIFICIAL SEQUENCE
  Engineered IL-1R-I binding polypeptide
VDAKYAKETVEAQMEIFNLPNLTRKQYTAFIRKLLDDPSQSSELLSEAKKLNDSQAPK

SEQ ID NO: 1129 - protein, 58 aa, ARTIFICIAL SEQUENCE
  Engineered IL-1R-I binding polypeptide
VDAKYAKEVEDAYMEIYFLPNLTRRQYTAFIRKLLDDPSQSSELLSEAKKLNDSQAPK

SEQ ID NO: 1130 - protein, 58 aa, ARTIFICIAL SEQUENCE
  Engineered IL-1R-I binding polypeptide
VDAKYAKETETAQMEIYNLPNLTRKQYTAFIIKLLDDPSQSSELLSEAKKLNDSQAPK

SEQ ID NO: 1131 - protein, 58 aa, ARTIFICIAL SEQUENCE
  Engineered IL-1R-I binding polypeptide
VDAKYAKEVEIAQMEIFRLPNLTRKQYTAFIRKLLDDPSQSSELLSEAKKLNDSQAPK

SEQ ID NO: 1132 - protein, 58 aa, ARTIFICIAL SEQUENCE
  Engineered IL-1R-I binding polypeptide
VDAKYAKEVHLAQMEIFSLPNLTRKQYTAFIRKLLDDPSQSSELLSEAKKLNDSQAPK

SEQ ID NO: 1133 - protein, 58 aa, ARTIFICIAL SEQUENCE
  Engineered IL-1R-I binding polypeptide
VDAKYAKEVEYAQMEIFSLPNLTRKQYTAFIRKLLDDPSQSSELLSEAKKLNDSQAPK

SEQ ID NO: 1134 - protein, 58 aa, ARTIFICIAL SEQUENCE
  Engineered IL-1R-I binding polypeptide
VDAKYAKEAEEAQHEIFSLPNLTRKQYTAFIRKLLDDPSQSSELLSEAKKLNDSQAPK

SEQ ID NO: 1135 - protein, 58 aa, ARTIFICIAL SEQUENCE
  Engineered IL-1R-I binding polypeptide
VDAKYAKEAYVAQMEIFSLPNLTRKQYTAFIRKLLDDPSQSSELLSEAKKLNDSQAPK

SEQ ID NO: 1136 - protein, 58 aa, ARTIFICIAL SEQUENCE
  Engineered IL-1R-I binding polypeptide
VDAKYAKEVQKAQMEIFELPNLTRKQYTAFIRKLFDDPSQSSELLSEAKKLNDSQAPK

SEQ ID NO: 1137 - protein, 58 aa, ARTIFICIAL SEQUENCE
  Engineered IL-1R-I binding polypeptide
VDAKYAKEAYAAQHEIFALPNLTRKQYTAFIRKLLDDPSQSSELLSEAKKLNDSQAPK

SEQ ID NO: 1138 - protein, 58 aa, ARTIFICIAL SEQUENCE
  Engineered IL-1R-I binding polypeptide
VDAKYAKEVERAYYEIYALPNLTRKQYTAFIRKLLDDPSQSSELLSEAKKLNDSQAPK

SEQ ID NO: 1139 - protein, 58 aa, ARTIFICIAL SEQUENCE
  Engineered IL-1R-I binding polypeptide
VDAKYAKEVEAAQMEIFELPNLTRKQYTAFIRKLLDDPSQSSELLSEAKKLNDSQAPK

SEQ ID NO: 1140 - protein, 58 aa, ARTIFICIAL SEQUENCE
  Engineered IL-1R-I binding polypeptide
VDAKYAKELENAQMEIFTLPNLTRKQYTAFIRKLLDDPSQSSELLSEAKKLNDSQAPK

SEQ ID NO: 1141 - protein, 58 aa, ARTIFICIAL SEQUENCE
  Engineered IL-1R-I binding polypeptide
VDAKYAKELEYAQQEIFHLPNLTRKQYTAFIRKLFDDPSQSSELLSEAKKLNDSQAPK

SEQ ID NO: 1142 - protein, 58 aa, ARTIFICIAL SEQUENCE
  Engineered IL-1R-I binding polypeptide
VDAKYAKEQLNAQMEIFSLPNLTRKQYTAFIRKLLDDPSQSSELLSEAKKLNDSQAPK

SEQ ID NO: 1143 - protein, 58 aa, ARTIFICIAL SEQUENCE
  Engineered IL-1R-I binding polypeptide
VDAKYAKEVIAAYYEIYDLPNLTRKQYTAFIRKLLDDPSQSSELLSEAKKLNDSQAPK

SEQ ID NO: 1144 - protein, 58 aa, ARTIFICIAL SEQUENCE
  Engineered IL-1R-I binding polypeptide
VDAKYAKEVVDAYWEIYSLPNLTRKQYTAFIRKLLDDPSQSSELLSEAKKLNDSQAPK

SEQ ID NO: 1145 - protein, 58 aa, ARTIFICIAL SEQUENCE
  Engineered IL-1R-I binding polypeptide
VDAKYAKEVEEAYQEIFRLPNLTRKQYTAFIRKLLDDPSQSSELLSEAKKLNDSQAPK

SEQ ID NO: 1146 - protein, 58 aa, ARTIFICIAL SEQUENCE
  Engineered IL-1R-I binding polypeptide
VDAKYAKEAEDAYFEIFALPNLTRKQYTAFIRKLLDDPSQSSELLSEAKKLNDSQAPK

SEQ ID NO: 1147 - protein, 58 aa, ARTIFICIAL SEQUENCE
  Engineered IL-1R-I binding polypeptide
VDAKYAKEVEDAYFEIYRLPNLTRKQYTAFIRKLLDDPSQSSELLSEAKKLNDSQAPK

SEQ ID NO: 1148 - protein, 58 aa, ARTIFICIAL SEQUENCE
  Engineered IL-1R-I binding polypeptide
VDAKYAKEVEVAYYEIYRLPNLTRKQYTAFIRKLLDDPSQSSELLSEAKKLNDSQAPK

SEQ ID NO: 1149 - protein, 58 aa, ARTIFICIAL SEQUENCE
  Engineered IL-1R-I binding polypeptide
VDAKYAKELEDAYMEIFKLPNLTRKQYTAFIRKLLDDPSQSSELLSEAKKLNDSQAPK

SEQ ID NO: 1150 - protein, 58 aa, ARTIFICIAL SEQUENCE
  Engineered IL-1R-I binding polypeptide
VDAKYAKEVDEAYWEIYALPNLTRKQYTAFIRKLLDDPSQSSELLSEAKKLNDSQAPK

SEQ ID NO: 1151 - protein, 58 aa, ARTIFICIAL SEQUENCE
  Engineered IL-1R-I binding polypeptide
VDAKYAKEAEWAYWEIYKLPNLTRKQYTAFIRKLLDDPSQSSELLSEAKKLNDSQAPK

SEQ ID NO: 1152 - protein, 58 aa, ARTIFICIAL SEQUENCE
  Engineered IL-1R-I binding polypeptide
VDAKYAKEVEVAYMEIFHLPNLTRKQYTAFIRKLLDDPSQSSELLSEAKKLNDSQAPK

SEQ ID NO: 1153 - protein, 58 aa, ARTIFICIAL SEQUENCE
  Engineered IL-1R-I binding polypeptide
VDAKYAKETERAYMEIYHLPNLTRKQYTAFIRKLLDDPSQSSELLSEAKKLNDSQAPK

SEQ ID NO: 1154 - protein, 58 aa, ARTIFICIAL SEQUENCE
  Engineered IL-1R-I binding polypeptide
VDAKYAKEHIAAYFEIYELPNLTRKQYTAFIRKLLDDPSQSSELLSEAKKLNDSQAPK

SEQ ID NO: 1155 - protein, 58 aa, ARTIFICIAL SEQUENCE
  Engineered IL-1R-I binding polypeptide
VDAKYAKEVEEAYYEIFGLPNLTRKQYTAFIRKLLDDPSQSSELLSEAKKLNDSQAPK

SEQ ID NO: 1156 - protein, 58 aa, ARTIFICIAL SEQUENCE
  Engineered IL-1R-I binding polypeptide
VDAKYAKEVEDAYQEIYQLPNLTRKQYTAFIRKLLDDPSQSSELLSEAKKLNDSQAPK

SEQ ID NO: 1157 - protein, 58 aa, ARTIFICIAL SEQUENCE
  Engineered IL-1R-I binding polypeptide
VDAKYAKETVEAYYEIYRLPNLTRKQYTAFIRKLLDDPSQSSELLSEAKKLNDSQAPK

SEQ ID NO: 1158 - protein, 58 aa, ARTIFICIAL SEQUENCE
  Engineered IL-1R-I binding polypeptide
VDAKYAKEVEQAYYEIYALPNLTRKQYTAFIRKLLDDPSQSSELLSEAKKLNDSQAPK

SEQ ID NO: 1159 - protein, 58 aa, ARTIFICIAL SEQUENCE
  Engineered IL-1R-I binding polypeptide
VDAKYAKEVVEAYDEIFALPNLTRKQYTAFIRKLLDDPSQSSELLSEAKKLNDSQAPK

SEQ ID NO: 1160 - protein, 58 aa, ARTIFICIAL SEQUENCE
  Engineered IL-1R-I binding polypeptide
VDAKYAKEVEEAYMEIYGLPNLTRKQYTAFIRKLLDDPSQSSELLSEAKKLNDSQAPK

SEQ ID NO: 1161 - protein, 58 aa, ARTIFICIAL SEQUENCE
  Engineered IL-1R-I binding polypeptide
VDAKYAKEVDDAYMEIFRLPNLTRKQYTAFIRKLLDDPSQSSELLSEAKKLNDSQAPK

SEQ ID NO: 1162 - protein, 58 aa, ARTIFICIAL SEQUENCE
  Engineered IL-1R-I binding polypeptide
VDAKYAKEVQDAYMEIYGLPNLTRKQYTAFIRKLLDDPSQSSELLSEAKKLNDSQAPK

SEQ ID NO: 1163 - protein, 58 aa, ARTIFICIAL SEQUENCE
  Engineered IL-1R-I binding polypeptide
VDAKYAKEAQQAYDEIFQLPNLTRKQYTAFIRKLLDDPSQSSELLSEAKKLNDSQAPK

SEQ ID NO: 1164 - protein, 58 aa, ARTIFICIAL SEQUENCE
  Engineered IL-1R-I binding polypeptide
VDAKYAKEVEFAYMEIYRLPNLTRKQYTAFIRKLLDDPSQSSELLSEAKKLNDSQAPK

SEQ ID NO: 1165 - protein, 58 aa, ARTIFICIAL SEQUENCE
  Engineered IL-1R-I binding polypeptide
VDAKYAKEVEIAYFEIYQLPNLTRKQYTAFIRKLLDDPSQSSELLSEAKKLNDSQAPK

SEQ ID NO: 1166 - protein, 58 aa, ARTIFICIAL SEQUENCE
  Engineered IL-1R-I binding polypeptide
VDAKYAKETEKAYFEIFGLPNLTRKQYTAFIRKLLDDPSQSSELLSEAKKLNDSQAPK

SEQ ID NO: 1167 - protein, 58 aa, ARTIFICIAL SEQUENCE
  Engineered IL-1R-I binding polypeptide
VDAKYAKEVTNAYMEIYELPNLTRKQYTAFIRKLLDDPSQSSELLSEAKKLNDSQAPK

SEQ ID NO: 1168 - protein, 58 aa, ARTIFICIAL SEQUENCE
  Engineered IL-1R-I binding polypeptide
VDAKYAKETEAAYFEIFKLPNLTRKQYTAFIRKLLDDPSQSSELLSEAKKLNDSQAPK

SEQ ID NO: 1169 - protein, 58 aa, ARTIFICIAL SEQUENCE
  Engineered IL-1R-I binding polypeptide
VDAKYAKEVETAYMEIYALPNLTRKQYTAFIRKLLDDPSQSSELLSEAKKLNDSQAPK

SEQ ID NO: 1170 - protein, 58 aa, ARTIFICIAL SEQUENCE
  Engineered IL-1R-I binding polypeptide
VDAKYAKEAEDAYMEIYKLPNLTRKQYTAFIRKLLDDPSQSSELLSEAKKLNDSQAPK

SEQ ID NO: 1171 - protein, 58 aa, ARTIFICIAL SEQUENCE
  Engineered IL-1R-I binding polypeptide
VDAKYAKEVEEAYQEIFHLPNLTRKQYTAFIRKLLDDPSQSSELLSEAKKLNDSQAPK

SEQ ID NO: 1172 - protein, 58 aa, ARTIFICIAL SEQUENCE
  Engineered IL-1R-I binding polypeptide
VDAKYAKETEEAYFEIYRLPNLTRKQYTAFIRKLLDDPSQSSELLSEAKKLNDSQAPK

SEQ ID NO: 1173 - protein, 58 aa, ARTIFICIAL SEQUENCE
  Engineered IL-1R-I binding polypeptide
VDAKYAKEAISAYWEIFALPNLTRKQYTAFIRKLLDDPSQSSELLSEAKKLNDSQAPK

SEQ ID NO: 1174 - protein, 58 aa, ARTIFICIAL SEQUENCE
  Engineered IL-1R-I binding polypeptide
VDAKYAKEVEEAYQEIYRLPNLTRKQYTAFIRKLLDDPSQSSELLSEAKKLNDSQAPK

SEQ ID NO: 1175 - protein, 58 aa, ARTIFICIAL SEQUENCE
  Engineered IL-1R-I binding polypeptide
VDAKYAKEVVYAQHEIFYLPNLTRKQYTAFIRKLLDDPSQSSELLSEAKKLNDSQAPK

SEQ ID NO: 1176 - protein, 58 aa, ARTIFICIAL SEQUENCE
  Engineered IL-1R-I binding polypeptide
VDAKYAKEIEVAYMEIYHLPNLTRKQYTAFIRKLLDDPSQSSELLSEAKKLNDSQAPK

SEQ ID NO: 1177 - protein, 58 aa, ARTIFICIAL SEQUENCE
  Engineered IL-1R-I binding polypeptide
VDAKYAKEVEYAYYEIFGLPNLTRKQYTAFIRKLLDDPSQSSELLSEAKKLNDSQAPK

SEQ ID NO: 1178 - protein, 58 aa, ARTIFICIAL SEQUENCE
  Engineered IL-1R-I binding polypeptide
VDAKYAKEVEQAYMEIFHLPNLTRKQYTAFIRKLLDDPSQSSELLSEAKKLNDSQAPK

SEQ ID NO: 1179 - protein, 58 aa, ARTIFICIAL SEQUENCE
  Engineered IL-1R-I binding polypeptide
VDAKYAKEVEDAYDEIYQLPNLTRKQYTAFIRKLLDDPSQSSELLSEAKKLNDSQAPK

SEQ ID NO: 1180 - protein, 58 aa, ARTIFICIAL SEQUENCE
  Engineered IL-1R-I binding polypeptide
VDAKYAKEIERAYYEIYDLPNLTRKQYTAFIRKLLDDPSQSSELLSEAKKLNDSQAPK

SEQ ID NO: 1181 - protein, 58 aa, ARTIFICIAL SEQUENCE
  Engineered IL-1R-I binding polypeptide
VDAKYAKEVEDAYFEIYYLPNLTRKQYTAFIRKLLDDPSQSSELLSEAKKLNDSQAPK

SEQ ID NO: 1182 - protein, 58 aa, ARTIFICIAL SEQUENCE
  Engineered IL-1R-I binding polypeptide
VDAKYAKEVEQAYWEIYALPNLTRKQYTAFIRKLLDDPSQSSELLSEAKKLNDSQAPK

SEQ ID NO: 1183 - protein, 58 aa, ARTIFICIAL SEQUENCE
  Engineered IL-1R-I binding polypeptide
VDAKYAKEVEEAYQEIFKLPNLTRKQYTAFIRKLLDDPSQSSELLSEAKKLNDSQAPK

SEQ ID NO: 1184 - protein, 58 aa, ARTIFICIAL SEQUENCE
  Engineered IL-1R-I binding polypeptide
VDAKYAKEAEHAYWEIYALPNLTRKQYTAFIRKLLDDPSQSSELLSEAKKLNDSQAPK

SEQ ID NO: 1185 - protein, 58 aa, ARTIFICIAL SEQUENCE
  Engineered IL-1R-I binding polypeptide
VDAKYAKEVEKAYYEIYNLPNLTRKQYTAFIRKLLDDPSQSSELLSEAKKLNDSQAPK

SEQ ID NO: 1186 - protein, 58 aa, ARTIFICIAL SEQUENCE
  Engineered IL-1R-I binding polypeptide
VDAKYAKEVEEAYMEIYKLPNLTRKQYTAFIRKLLDDPSQSSELLSEAKKLNDSQAPK

SEQ ID NO: 1187 - protein, 58 aa, ARTIFICIAL SEQUENCE
  Engineered IL-1R-I binding polypeptide
VDAKYAKEIEDAYQEIYELPNLTRKQYTAFIRKLLDDPSQSSELLSEAKKLNDSQAPK

SEQ ID NO: 1188 - protein, 58 aa, ARTIFICIAL SEQUENCE
  Engineered IL-1R-I binding polypeptide
VDAKYAKEVENAYYEIFDLPNLTRKQYTAFIRKLLDDPSQSSELLSEAKKLNDSQAPK

SEQ ID NO: 1189 - protein, 58 aa, ARTIFICIAL SEQUENCE
  Engineered IL-1R-I binding polypeptide
VDAKYAKEATEAYWEIYQLPNLTRKQYTAFIRKLLDDPSQSSELLSEAKKLNDSQAPK

SEQ ID NO: 1190 - protein, 58 aa, ARTIFICIAL SEQUENCE
  Engineered IL-1R-I binding polypeptide
VDAKYAKEADAAYFEIYHLPNLTRKQYTAFIRKLLDDPSQSSELLSEAKKLNDSQAPK

SEQ ID NO: 1191 - protein, 58 aa, ARTIFICIAL SEQUENCE
  Engineered IL-1R-I binding polypeptide
VDAKYAKEVINAYWEIYALPNLTRKQYTAFIRKLLDDPSQSSELLSEAKKLNDSQAPK

SEQ ID NO: 1192 - protein, 58 aa, ARTIFICIAL SEQUENCE
  Engineered IL-1R-I binding polypeptide
VDAKYAKEAVDAYWEIFALPNLTRKQYTAFIRKLLDDPSQSSELLSEAKKLNDSQAPK

SEQ ID NO: 1193 - protein, 58 aa, ARTIFICIAL SEQUENCE
  Engineered IL-1R-I binding polypeptide
VDAKYAKEVEEAYYEIYELPNLTRKQYTAFIRKLLDDPSQSSELLSEAKKLNDSQAPK

SEQ ID NO: 1194 - protein, 58 aa, ARTIFICIAL SEQUENCE
  Engineered IL-1R-I binding polypeptide
VDAKYAKEVEYAYFEIYSLPNLTRKQYTAFIRKLLDDPSQSSELLSEAKKLNDSQAPK

SEQ ID NO: 1195 - protein, 58 aa, ARTIFICIAL SEQUENCE
  Engineered IL-1R-I binding polypeptide
VDAKYAKEAEKAYYEIFNLPNLTRKQYTAFIRKLLDDPSQSSELLSEAKKLNDSQAPK

SEQ ID NO: 1196 - protein, 58 aa, ARTIFICIAL SEQUENCE
  Engineered IL-1R-I binding polypeptide
VDAKYAKETIDAYYEIYGLPNLTRKQYTAFIRKLLDDPSQSSELLSEAKKLNDSQAPK

SEQ ID NO: 1197 - protein, 58 aa, ARTIFICIAL SEQUENCE
  Engineered IL-1R-I binding polypeptide
VDAKYAKEVEVAYAEIFNLPNLTRKQYTAFIRKLLDDPSQSSELLSEAKKLNDSQAPK

SEQ ID NO: 1198 - protein, 58 aa, ARTIFICIAL SEQUENCE
  Engineered IL-1R-I binding polypeptide
VDAKYAKEVETAYFEIYALPNLTRKQYTAFIRKLLDDPSQSSELLSEAKKLNDSQAPK

SEQ ID NO: 1199 - protein, 58 aa, ARTIFICIAL SEQUENCE
  Engineered IL-1R-I binding polypeptide
VDAKYAKEAYIAQMEIFGLPNLTRKQYTAFIRKLLDDPSQSSELLSEAKKLNDSQAPK

SEQ ID NO: 1200 - protein, 58 aa, ARTIFICIAL SEQUENCE
  Engineered IL-1R-I binding polypeptide
VDAKYAKEVEEAYFEIYNLPNLTRRQYTAFIRKLLDDPSQSSELLSEAKKLNDSQAPK

SEQ ID NO: 1201 - protein, 58 aa, ARTIFICIAL SEQUENCE
  Engineered IL-1R-I binding polypeptide
VDAKYAKESEAAYWEIYELPNLTRKQYTAFIRKLLDDPSQSSELLSEAKKLNDSQAPK

SEQ ID NO: 1202 - protein, 58 aa, ARTIFICIAL SEQUENCE
  Engineered IL-1R-I binding polypeptide
VDAKYAKEAEDAYWEIFALPNLTRKQYTAFIRKLLDDPSQSSELLSEAKKLNDSQAPK

SEQ ID NO: 1203 - protein, 58 aa, ARTIFICIAL SEQUENCE
  Engineered IL-1R-I binding polypeptide
VDAKYAKEVDAAYWEIYGLPNLTRKQYTAFIRKLLDDPSQSSELLSEAKKLNDSQAPK

SEQ ID NO: 1204 - protein, 58 aa, ARTIFICIAL SEQUENCE
  Engineered IL-1R-I binding polypeptide
VDAKYAKETVDAYYEIYELPNLTRKQYTAFIRKLLDDPSQSSELLSEAKKLNDSQAPK

SEQ ID NO: 1205 - protein, 58 aa, ARTIFICIAL SEQUENCE
  Engineered IL-1R-I binding polypeptide
VDAKYAKEIEAVQMEIFYLPNLTRKQYTAFIRKLFDDPSQSSELLSEAKKLNDSQAPK

SEQ ID NO: 1206 - protein, 58 aa, ARTIFICIAL SEQUENCE
  Engineered IL-1R-I binding polypeptide
VDAKYAKEIEAAQMEIFGLPNLTRKQYTAFIRKLFDDPSQSSELLSEAKKLNDSQAPK

SEQ ID NO: 1207 - protein, 58 aa, ARTIFICIAL SEQUENCE
  Engineered IL-1R-I binding polypeptide
VDAKYAKEVEEAQMEIFILPNLTRKQYTAFIRKLLDDPSQSSELLSEAKKLNDSQAPK

SEQ ID NO: 1208 - protein, 58 aa, ARTIFICIAL SEQUENCE
  Engineered IL-1R-I binding polypeptide
VDAKYAKEVTVAQMEIFALPNLTRKQYTAFIRKLLDDPSQSSELLSEAKKLNDSQAPK

SEQ ID NO: 1209 - protein, 58 aa, ARTIFICIAL SEQUENCE
  Engineered IL-1R-I binding polypeptide
VDAKYAKEVETAQMEIFVLPNLTRKQYTAFIRKLLDDPSQSSELLSEAKKLNDSQAPK

SEQ ID NO: 1210 - protein, 58 aa, ARTIFICIAL SEQUENCE
  Engineered IL-1R-I binding polypeptide
VDAKYAKEAEDAYWEIYALPNLTRKQYTAFIRKLLDDPSQSSELLSEAKKLNDSQAPK

SEQ ID NO: 1211 - protein, 58 aa, ARTIFICIAL SEQUENCE
  Engineered IL-1R-I binding polypeptide
VDAKYAKEAIEAYWEIYALPNLTRKQYTAFIRKLLDDPSQSSELLSEAKKLNDSQAPK

SEQ ID NO: 1212 - protein, 58 aa, ARTIFICIAL SEQUENCE
  Engineered IL-1R-I binding polypeptide
VDAKYAKEVVAAYYEIFELPNLTRKQYTAFIRKLLDDPSQSSELLSEAKKLNDSQAPK

SEQ ID NO: 1213 - protein, 58 aa, ARTIFICIAL SEQUENCE
  Engineered IL-1R-I binding polypeptide
VDAKYAKEVVSAYYEIYELPNLTRKQYTAFIRKLLDDPSQSSELLSEAKKLNDSQAPK

SEQ ID NO: 1214 - protein, 58 aa, ARTIFICIAL SEQUENCE
  Engineered IL-1R-I binding polypeptide
VDAKYAKEIEIAYMEIFHLPNLTRKQYTAFIRKLLDDPSQSSELLSEAKKLNDSQAPK

SEQ ID NO: 1215 - protein, 58 aa, ARTIFICIAL SEQUENCE
  Engineered IL-1R-I binding polypeptide
VDAKYAKELDVAYMEIYRLPNLTRKQYTAFIRKLLDDPSQSSELLSEAKKLNDSQAPK

SEQ ID NO: 1216 - protein, 58 aa, ARTIFICIAL SEQUENCE
  Engineered IL-1R-I binding polypeptide
VDAKYAKEAEVAYMEIYRLPNLTRKQYTAFIRKLLDDPSQSSELLSEAKKLNDSQAPK

SEQ ID NO: 1217 - protein, 58 aa, ARTIFICIAL SEQUENCE
  Engineered IL-1R-I binding polypeptide
VDAKYAKELERAYYEIYGLPNLTRKQYTAFIRKLLDDPSQSSELLSEAKKLNDSQAPK

SEQ ID NO: 1218 - protein, 58 aa, ARTIFICIAL SEQUENCE
  Engineered IL-1R-I binding polypeptide
VDAKYAKEAEIAYYEIYSLPNLTRKQYTAFIRKLLDDPSQSSELLSEAKKLNDSQAPK

SEQ ID NO: 1219 - protein, 58 aa, ARTIFICIAL SEQUENCE
  Engineered IL-1R-I binding polypeptide
VDAKYAKETEVAYYEIYALPNLTRKQYTAFIRKLLDDPSQSSELLSEAKKLNDSQAPK

SEQ ID NO: 1220 - protein, 58 aa, ARTIFICIAL SEQUENCE
  Engineered IL-1R-I binding polypeptide
VDAKYAKEVEAAYWEIYALPNLTRKQYTAFIRKLLDDPSQSSELLSEAKKLNDSQAPK

SEQ ID NO: 1221 - protein, 58 aa, ARTIFICIAL SEQUENCE
  Engineered IL-1R-I binding polypeptide
VDAKYAKEVEIAYMEIYNLPNLTRKQYTAFIRKLLDDPSQSSELLSEAKKLNDSQAPK

SEQ ID NO: 1222 - protein, 58 aa, ARTIFICIAL SEQUENCE
  Engineered IL-1R-I binding polypeptide
VDAKYAKEVEVAYFEIYNLPNLTRKQYTAFIRKLLDDPSQSSELLSEAKKLNDSQAPK

SEQ ID NO: 1223 - protein, 58 aa, ARTIFICIAL SEQUENCE
  Engineered IL-1R-I binding polypeptide
VDAKYAKEHEEAYMEIYHLPNLTRKQYTAFIRKLLDDPSQSSELLSEAKKLNDSQAPK

SEQ ID NO: 1224 - protein, 58 aa, ARTIFICIAL SEQUENCE
  Engineered IL-1R-I binding polypeptide
VDAKYAKELERAYMEIYHLPNLTRKQYTAFIRKLLDDPSQSSELLSEAKKLNDSQAPK

SEQ ID NO: 1225 - protein, 58 aa, ARTIFICIAL SEQUENCE
  Engineered IL-1R-I binding polypeptide
VDAKYAKEVEHAYMEIYHLPNLTRKQYTAFIRKLLDDPSQSSELLSEAKKLNDSQAPK

SEQ ID NO: 1226 - protein, 58 aa, ARTIFICIAL SEQUENCE
  Engineered IL-1R-I binding polypeptide
VDAKYAKEVQEAYMEIFALPNLTRRQYTAFIRKLLDDPSQSSELLSEAKKLNDSQAPK

SEQ ID NO: 1227 - protein, 58 aa, ARTIFICIAL SEQUENCE
  Engineered IL-1R-I binding polypeptide
VDAKYAKEVKIAQMEIFNLPNLTRKQYTAFIRKLFDDPSQSSELLSEAKKLNDSQAPK

SEQ ID NO: 1228 - protein, 58 aa, ARTIFICIAL SEQUENCE
  Engineered IL-1R-I binding polypeptide
VDAKYAKEVEWAQMEIFDLPNLTRKQYTAFIRKLLDDPSQSSELLSEAKKLNDSQAPK

SEQ ID NO: 1229 - protein, 58 aa, ARTIFICIAL SEQUENCE
  Engineered IL-1R-I binding polypeptide
VDAKYAKEAHSAQMEIFALPNLTRKQYTAFIRKLLDDPSQSSELLSEAKKLNDSQAPK

SEQ ID NO: 1230 - protein, 58 aa, ARTIFICIAL SEQUENCE
  Engineered IL-1R-I binding polypeptide
VDAKYAKEAERAQMEIFALPNLTRKQYTAFIRKLLDDPSQSSELLSEAKKLNDSQAPK

SEQ ID NO: 1231 - protein, 58 aa, ARTIFICIAL SEQUENCE
  Engineered IL-1R-I binding polypeptide
VDAKYAKETEAAQMEIYKLPNLTRKQYTAFIRKLLDDPSQSSELLSEAKKLNDSQAPK

SEQ ID NO: 1232 - protein, 58 aa, ARTIFICIAL SEQUENCE
  Engineered IL-1R-I binding polypeptide
VDAKYAKELEQAQMEIFYLPNLTRKQYTAFIRKLFDDPSQSSELLSEAKKLNDSQAPK

SEQ ID NO: 1233 - protein, 58 aa, ARTIFICIAL SEQUENCE
  Engineered IL-1R-I binding polypeptide
VDAKYAKEVESAQMEIFELPNLTRKQYTAFIRKLLDDPSQSSELLSEAKKLNDSQAPK

SEQ ID NO: 1234 - protein, 58 aa, ARTIFICIAL SEQUENCE
  Engineered IL-1R-I binding polypeptide
VDAKYAKEVEDAQMEIYQLPNLTRRQYTAFIRKLLDDPSQSSELLSEAKKLNDSQAPK

SEQ ID NO: 1235 - protein, 58 aa, ARTIFICIAL SEQUENCE
  Engineered IL-1R-I binding polypeptide
VDAKYAKEIEDAQMEIYDLPNLTRRQYTAFIRKLLDDPSQSSELLSEAKKLNDSQAPK

SEQ ID NO: 1236 - protein, 58 aa, ARTIFICIAL SEQUENCE
  Engineered IL-1R-I binding polypeptide
VDAKYAKEVEQAQMEIFKLPNLTRKQYTAFIRKLLDDPSQSSELLSEAKKLNDSQAPK

SEQ ID NO: 1237 - protein, 58 aa, ARTIFICIAL SEQUENCE
  Engineered IL-1R-I binding polypeptide
VDAKYAKEVEHAQMEIYSLPNLTRKQYTAFIRKLLDDPSQSSELLSEAKKLNDSQAPK

SEQ ID NO: 1238 - protein, 58 aa, ARTIFICIAL SEQUENCE
  Engineered IL-1R-I binding polypeptide
VDAKYAKEVEKAQMEIFSLPNLTRKQYTAFIRKLFDDPSQSSELLSEAKKLNDSQAPK

SEQ ID NO: 1239 - protein, 58 aa, ARTIFICIAL SEQUENCE
  Engineered IL-1R-I binding polypeptide
VDAKYAKEIEDAQMEIFSLPNLTRKQYTAFIRKLLDDPSQSSELLSEAKKLNDSQAPK

SEQ ID NO: 1240 - protein, 58 aa, ARTIFICIAL SEQUENCE
  Engineered IL-1R-I binding polypeptide
VDAKYAKEVEEAQMEIYGLPNLTRKQYTAFIRKLLDDPSQSSELLSEAKKLNDSQAPK

SEQ ID NO: 1241 - protein, 58 aa, ARTIFICIAL SEQUENCE
  Engineered IL-1R-I binding polypeptide
VDAKYAKEIEKAQMEIFALPNLTRRQYTAFIRKLLDDPSQSSELLSEAKKLNDSQAPK

SEQ ID NO: 1242 - protein, 58 aa, ARTIFICIAL SEQUENCE
  Engineered IL-1R-I binding polypeptide
VDAKYAKETYVAQMEIFALPNLTRKQYTAFIRKLLDDPSQSSELLSEAKKLNDSQAPK

SEQ ID NO: 1243 - protein, 58 aa, ARTIFICIAL SEQUENCE
  Engineered IL-1R-I binding polypeptide
VDAKYAKEVEIAQMEIFYLPNLTRKQYTAFIRKLLDDPSQSSELLSEAKKLNDSQAPK

SEQ ID NO: 1244 - protein, 58 aa, ARTIFICIAL SEQUENCE
  Engineered IL-1R-I binding polypeptide
VDAKYAKEVKVAQMEIFALPNLTRKQYTAFIRKLLDDPSQSSELLSEAKKLNDSQAPK

SEQ ID NO: 1245 - protein, 58 aa, ARTIFICIAL SEQUENCE
  Engineered IL-1R-I binding polypeptide
VDAKYAKEVEYAQMEIFALPNLTRKQYTAFIRKLFDDPSQSSELLSEAKKLNDSQAPK

SEQ ID NO: 1246 - protein, 58 aa, ARTIFICIAL SEQUENCE
  Engineered IL-1R-I binding polypeptide
VDAKYAKEVETAQMEIFYLPNLTRKQYTAFIRKLLDDPSQSSELLSEAKKLNDSQAPK

SEQ ID NO: 1247 - protein, 58 aa, ARTIFICIAL SEQUENCE
  Engineered IL-1R-I binding polypeptide
VDAKYAKEVEAAQMEIFKLPNLTRKQYTAFIRKLLDDPSQSSELLSEAKKLNDSQAPK

SEQ ID NO: 1248 - protein, 58 aa, ARTIFICIAL SEQUENCE
  Engineered IL-1R-I binding polypeptide
VDAKYAKEIEAAQMEIFGLPNLTRKQYTAFIRKLLDDPSQSSELLSEAKKLNDSQAPK

SEQ ID NO: 1249 - protein, 58 aa, ARTIFICIAL SEQUENCE
  Engineered IL-1R-I binding polypeptide
VDAKYAKETEAAQMEIYALPNLTRKQYTAFIRKLFDDPSQSSELLSEAKKLNDSQAPK

SEQ ID NO: 1250 - protein, 58 aa, ARTIFICIAL SEQUENCE
  Engineered IL-1R-I binding polypeptide
VDAKYAKEIETIQHEIYELPNLTRKQYTAFIRKLLDDPSQSSELLSEAKKLNDSQAPK

SEQ ID NO: 1251 - protein, 58 aa, ARTIFICIAL SEQUENCE
  Engineered IL-1R-I binding polypeptide
VDAKYAKETEEIQMEIFHLPNLTRKQYTAFIRKLLDDPSQSSELLSEAKKLNDSQAPK

SEQ ID NO: 1252 - protein, 58 aa, ARTIFICIAL SEQUENCE
  Engineered IL-1R-I binding polypeptide
VDAKYAKEVEEIQMEIFRLPNLTRRQYTAFIRKLLDDPSQSSELLSEAKKLNDSQAPK

SEQ ID NO: 1253 - protein, 58 aa, ARTIFICIAL SEQUENCE
  Engineered IL-1R-I binding polypeptide
VDAKYAKEVEEVYFEIFRLPNLTRKQYTAFIRKLLDDPSQSSELLSEAKKLNDSQAPK

SEQ ID NO: 1254 - protein, 58 aa, ARTIFICIAL SEQUENCE
  Engineered IL-1R-I binding polypeptide
VDAKYAKETYEVQMEIYHLPNLTRKQYTAFIRKLLDDPSQSSELLSEAKKLNDSQAPK

SEQ ID NO: 1255 - protein, 58 aa, ARTIFICIAL SEQUENCE
  Engineered IL-1R-I binding polypeptide
VDAKYAKEAERVQMEIFGLPNLTRKQYTAFIRKLLDDPSQSSELLSEAKKLNDSQAPK

SEQ ID NO: 1256 - protein, 58 aa, ARTIFICIAL SEQUENCE
  Engineered IL-1R-I binding polypeptide
VDAKYAKEAEAIQMEIYDLPNLTRRQYTAFIRKLLDDPSQSSELLSEAKKLNDSQAPK

SEQ ID NO: 1257 - protein, 58 aa, ARTIFICIAL SEQUENCE
  Engineered IL-1R-I binding polypeptide
VDAKYAKETEVIQMEIFRLPNLTRRQYTAFIRKLLDDPSQSSELLSEAKKLNDSQAPK

SEQ ID NO: 1258 - protein, 58 aa, ARTIFICIAL SEQUENCE
  Engineered IL-1R-I binding polypeptide
VDAKYAKETEAIQMEIFQLPNLTRKQYTAFIRKLFDDPSQSSELLSEAKKLNDSQAPK

SEQ ID NO: 1259 - protein, 58 aa, ARTIFICIAL SEQUENCE
  Engineered IL-1R-I binding polypeptide
VDAKYAKETEAIQMEIFRLPNLTRKQYTAFIRKLLDDPSQSSELLSEAKKLNDSQAPK

SEQ ID NO: 1260 - protein, 58 aa, ARTIFICIAL SEQUENCE
  Engineered IL-1R-I binding polypeptide
VDAKYAKETEAVQMEIFRLPNLTRKQYTAFIRKLLDDPSQSSELLSEAKKLNDSQAPK

SEQ ID NO: 1261 - protein, 58 aa, ARTIFICIAL SEQUENCE
  Engineered IL-1R-I binding polypeptide
VDAKYAKETEAVQMEIFRLPNLTRRQYTAFIRKLLDDPSQSSELLSEAKKLNDSQAPK

SEQ ID NO: 1262 - protein, 58 aa, ARTIFICIAL SEQUENCE
  Engineered IL-1R-I binding polypeptide
VDAKYAKETEAVQMEIFTLPNLTRRQYTAFIRKLLDDPSQSSELLSEAKKLNDSQAPK

SEQ ID NO: 1263 - protein, 58 aa, ARTIFICIAL SEQUENCE
  Engineered IL-1R-I binding polypeptide
VDAKYAKETEAIQMEIFELPNLTRRQYTAFIRKLLDDPSQSSELLSEAKKLNDSQAPK

SEQ ID NO: 1264 - protein, 58 aa, ARTIFICIAL SEQUENCE
  Engineered IL-1R-I binding polypeptide
VDAKYAKETEAVQMEIFHLPNLTRRQYTAFIRKLLDDPSQSSELLSEAKKLNDSQAPK

SEQ ID NO: 1265 - protein, 58 aa, ARTIFICIAL SEQUENCE
  Engineered IL-1R-I binding polypeptide
VDAKYAKETEEIQMEIFLLPNLTRKQYTAFIRKLFDDPSQSSELLSEAKKLNDSQAPK

SEQ ID NO: 1266 - protein, 58 aa, ARTIFICIAL SEQUENCE
  Engineered IL-1R-I binding polypeptide
VDAKYAKETERVQMEIFYLPNLTRRQYTAFIRKLLDDPSQSSELLSEAKKLNDSQAPK

SEQ ID NO: 1267 - protein, 58 aa, ARTIFICIAL SEQUENCE
  Engineered IL-1R-I binding polypeptide
VDAKYAKETERVQMEIFQLPNLTRKQYTAFIRKLLDDPSQSSELLSEAKKLNDSQAPK

SEQ ID NO: 1268 - protein, 58 aa, ARTIFICIAL SEQUENCE
  Engineered IL-1R-I binding polypeptide
VDAKYAKETEEIQMEIFQLPNLTRRQYTAFIRKLLDDPSQSSELLSEAKKLNDSQAPK

SEQ ID NO: 1269 - protein, 58 aa, ARTIFICIAL SEQUENCE
  Engineered IL-1R-I binding polypeptide
VDAKYAKETEEVQMEIFKLPNLTRRQYTAFIRKLLDDPSQSSELLSEAKKLNDSQAPK

SEQ ID NO: 1270 - protein, 58 aa, ARTIFICIAL SEQUENCE
  Engineered IL-1R-I binding polypeptide
VDAKYAKETEEIQMEIFRLPNLTRRQYTAFIRKLLDDPSQSSELLSEAKKLNDSQAPK

SEQ ID NO: 1271 - protein, 58 aa, ARTIFICIAL SEQUENCE
  Engineered IL-1R-I binding polypeptide
VDAKYAKETEEIQMEIFRLPNLTRKQYTAFIRKLLDDPSQSSELLSEAKKLNDSQAPK

SEQ ID NO: 1272 - protein, 58 aa, ARTIFICIAL SEQUENCE
  Engineered IL-1R-I binding polypeptide
VDAKYAKETEEVQMEIFRLPNLTRKQYTAFIRKLLDDPSQSSELLSEAKKLNDSQAPK

SEQ ID NO: 1273 - protein, 58 aa, ARTIFICIAL SEQUENCE
  Engineered IL-1R-I binding polypeptide
VDAKYAKETEQVQMEIFHLPNLTRKQYTAFIRKLLDDPSQSSELLSEAKKLNDSQAPK

SEQ ID NO: 1274 - protein, 58 aa, ARTIFICIAL SEQUENCE
  Engineered IL-1R-I binding polypeptide
VDAKYAKETEQVQMEIFHLPNLTRRQYTAFIRKLLDDPSQSSELLSEAKKLNDSQAPK

SEQ ID NO: 1275 - protein, 58 aa, ARTIFICIAL SEQUENCE
  Engineered IL-1R-I binding polypeptide
VDAKYAKETEKVQMEIFGLPNLTRKQYTAFIRKLFDDPSQSSELLSEAKKLNDSQAPK

SEQ ID NO: 1276 - protein, 58 aa, ARTIFICIAL SEQUENCE
  Engineered IL-1R-I binding polypeptide
VDAKYAKETEEVQMEIFGLPNLTRRQYTAFIRKLLDDPSQSSELLSEAKKLNDSQAPK

SEQ ID NO: 1277 - protein, 58 aa, ARTIFICIAL SEQUENCE
  Engineered IL-1R-I binding polypeptide
VDAKYAKETEEIQMEIYGLPNLTRKQYTAFIRKLLDDPSQSSELLSEAKKLNDSQAPK

SEQ ID NO: 1278 - protein, 58 aa, ARTIFICIAL SEQUENCE
  Engineered IL-1R-I binding polypeptide
VDAKYAKETEEVQMEIFGLPNLTRKQYTAFIRKLFDDPSQSSELLSEAKKLNDSQAPK

SEQ ID NO: 1279 - protein, 58 aa, ARTIFICIAL SEQUENCE
  Engineered IL-1R-I binding polypeptide
VDAKYAKETEAVQMEIFGLPNLTRRQYTAFIRKLLDDPSQSSELLSEAKKLNDSQAPK

SEQ ID NO: 1280 - protein, 58 aa, ARTIFICIAL SEQUENCE
  Engineered IL-1R-I binding polypeptide
VDAKYAKETEVVQMEIFGLPNLTRRQYTAFIRKLLDDPSQSSELLSEAKKLNDSQAPK

SEQ ID NO: 1281 - protein, 58 aa, ARTIFICIAL SEQUENCE
  Engineered IL-1R-I binding polypeptide
VDAKYAKETEVVQMEIFGLPNLTRRQYTAFIRKLFDDPSQSSELLSEAKKLNDSQAPK

SEQ ID NO: 1282 - protein, 58 aa, ARTIFICIAL SEQUENCE
  Engineered IL-1R-I binding polypeptide
VDAKYAKETEEVQMEIFSLPNLTRRQYTAFIRKLLDDPSQSSELLSEAKKLNDSQAPK

SEQ ID NO: 1283 - protein, 58 aa, ARTIFICIAL SEQUENCE
  Engineered IL-1R-I binding polypeptide
VDAKYAKETEEIQMEIFSLPNLTRRQYTAFIRKLLDDPSQSSELLSEAKKLNDSQAPK

SEQ ID NO: 1284 - protein, 58 aa, ARTIFICIAL SEQUENCE
  Engineered IL-1R-I binding polypeptide
VDAKYAKETERVQMEIFSLPNLTRRQYTAFIRKLLDDPSQSSELLSEAKKLNDSQAPK

SEQ ID NO: 1285 - protein, 58 aa, ARTIFICIAL SEQUENCE
  Engineered IL-1R-I binding polypeptide
VDAKYAKELEAIQMEIFYLPNLTRRQYVAFIRKLLDDPSQSSELLSEAKKLNDSQAPK

SEQ ID NO: 1286 - protein, 58 aa, ARTIFICIAL SEQUENCE
  Engineered IL-1R-I binding polypeptide
VDAKYAKEIEEIQMEIFYLPNLTRRQYVAFIRKLLDDPSQSSELLSEAKKLNDSQAPK

SEQ ID NO: 1287 - protein, 58 aa, ARTIFICIAL SEQUENCE
  Engineered IL-1R-I binding polypeptide
VDAKYAKELEKVQMEIFVLPNLTRRQYTAFIRKLLDDPSQSSELLSEAKKLNDSQAPK

SEQ ID NO: 1288 - protein, 58 aa, ARTIFICIAL SEQUENCE
  Engineered IL-1R-I binding polypeptide
VDAKYAKELERIQMEIFYLPNLTRRQYTAFIRKLLDDPSQSSELLSEAKKLNDSQAPK

SEQ ID NO: 1289 - protein, 58 aa, ARTIFICIAL SEQUENCE
  Engineered IL-1R-I binding polypeptide
VDAKYAKELEKVQMEIFYLPNLTRRQYTAFIRKLLDDPSQSSELLSEAKKLNDSQAPK

SEQ ID NO: 1290 - protein, 58 aa, ARTIFICIAL SEQUENCE
  Engineered IL-1R-I binding polypeptide
VDAKYAKEVEQIQMEIFYLPNLTRRQYTAFIRKLLDDPSQSSELLSEAKKLNDSQAPK

SEQ ID NO: 1291 - protein, 58 aa, ARTIFICIAL SEQUENCE
  Engineered IL-1R-I binding polypeptide
VDAKYAKEIEQIQMEIFYLPNLTRRQYTAFIRKLLDDPSQSSELLSEAKKLNDSQAPK

SEQ ID NO: 1292 - protein, 58 aa, ARTIFICIAL SEQUENCE
  Engineered IL-1R-I binding polypeptide
VDAKYAKEIEQVQMEIFYLPNLTRRQYTAFIRKLLDDPSQSSELLSEAKKLNDSQAPK

SEQ ID NO: 1293 - protein, 58 aa, ARTIFICIAL SEQUENCE
  Engineered IL-1R-I binding polypeptide
VDAKYAKEIEQIQMEIFYLPNLTRKQYTAFIRKLLDDPSQSSELLSEAKKLNDSQAPK

SEQ ID NO: 1294 - protein, 58 aa, ARTIFICIAL SEQUENCE
  Engineered IL-1R-I binding polypeptide
VDAKYAKEVEEIQMEIFYLPNLTRRQYTAFIRKLFDDPSQSSELLSEAKKLNDSQAPK

SEQ ID NO: 1295 - protein, 58 aa, ARTIFICIAL SEQUENCE
  Engineered IL-1R-I binding polypeptide
VDAKYAKEVEEIQMEIFFLPNLTRRQYTAFIRKLLDDPSQSSELLSEAKKLNDSQAPK

SEQ ID NO: 1296 - protein, 58 aa, ARTIFICIAL SEQUENCE
  Engineered IL-1R-I binding polypeptide
VDAKYAKEVEEIQMEIFYLPNLTRRQYTAFIRKLLDDPSQSSELLSEAKKLNDSQAPK

SEQ ID NO: 1297 - protein, 58 aa, ARTIFICIAL SEQUENCE
  Engineered IL-1R-I binding polypeptide
VDAKYAKEVEEVQMEIFYLPNLTRRQYTAFIRKLLDDPSQSSELLSEAKKLNDSQAPK

SEQ ID NO: 1298 - protein, 58 aa, ARTIFICIAL SEQUENCE
  Engineered IL-1R-I binding polypeptide
VDAKYAKEIEEIQMEIFYLPNLTRRQYTAFIRKLFDDPSQSSELLSEAKKLNDSQAPK

SEQ ID NO: 1299 - protein, 58 aa, ARTIFICIAL SEQUENCE
  Engineered IL-1R-I binding polypeptide
VDAKYAKEIEEVQMEIFYLPNLTRKQYTAFIRKLFDDPSQSSELLSEAKKLNDSQAPK

SEQ ID NO: 1300 - protein, 58 aa, ARTIFICIAL SEQUENCE
  Engineered IL-1R-I binding polypeptide
VDAKYAKELEEIQMEIFYLPNLTRKQYTAFIRKLLDDPSQSSELLSEAKKLNDSQAPK

SEQ ID NO: 1301 - protein, 58 aa, ARTIFICIAL SEQUENCE
  Engineered IL-1R-I binding polypeptide
VDAKYAKEVEEIQMEIFYLPNLTRKQYTAFIRKLLDDPSQSSELLSEAKKLNDSQAPK

SEQ ID NO: 1302 - protein, 58 aa, ARTIFICIAL SEQUENCE
  Engineered IL-1R-I binding polypeptide
VDAKYAKEVEEVQMEIFYLPNLTRKQYTAFIRKLLDDPSQSSELLSEAKKLNDSQAPK

SEQ ID NO: 1303 - protein, 58 aa, ARTIFICIAL SEQUENCE
  Engineered IL-1R-I binding polypeptide
VDAKYAKEIEEIQMEIFFLPNLTRRQYTAFIRKLLDDPSQSSELLSEAKKLNDSQAPK

SEQ ID NO: 1304 - protein, 58 aa, ARTIFICIAL SEQUENCE
  Engineered IL-1R-I binding polypeptide
VDAKYAKEIEEIQMEIFFLPNLTRKQYTAFIRKLLDDPSQSSELLSEAKKLNDSQAPK

SEQ ID NO: 1305 - protein, 58 aa, ARTIFICIAL SEQUENCE
  Engineered IL-1R-I binding polypeptide
VDAKYAKELEEVQMEIYFLPNLTRRQYTAFIRKLLDDPSQSSELLSEAKKLNDSQAPK

SEQ ID NO: 1306 - protein, 58 aa, ARTIFICIAL SEQUENCE
  Engineered IL-1R-I binding polypeptide
VDAKYAKELEEVQMEIFYLPNLTRRQYTAFIRKLLDDPSQSSELLSEAKKLNDSQAPK

SEQ ID NO: 1307 - protein, 58 aa, ARTIFICIAL SEQUENCE
  Engineered IL-1R-I binding polypeptide
VDAKYAKELEEIQMEIFYLPNLTRRQYTAFIRKLLDDPSQSSELLSEAKKLNDSQAPK

SEQ ID NO: 1308 - protein, 58 aa, ARTIFICIAL SEQUENCE
  Engineered IL-1R-I binding polypeptide
VDAKYAKEIEEVQMEIFYLPNLTRRQYTAFIRKLLDDPSQSSELLSEAKKLNDSQAPK

SEQ ID NO: 1309 - protein, 58 aa, ARTIFICIAL SEQUENCE
  Engineered IL-1R-I binding polypeptide
VDAKYAKEIEEIQMEIFYLPNLTRRQYTAFIRKLLDDPSQSSELLSEAKKLNDSQAPK

SEQ ID NO: 1310 - protein, 58 aa, ARTIFICIAL SEQUENCE
  Engineered IL-1R-I binding polypeptide
VDAKYAKEIEEIQMEIFDLPNLTRRQYTAFIRKLLDDPSQSSELLSEAKKLNDSQAPK

SEQ ID NO: 1311 - protein, 58 aa, ARTIFICIAL SEQUENCE
  Engineered IL-1R-I binding polypeptide
VDAKYAKEVEEVQMEIFDLPNLTRRQYTAFIRKLLDDPSQSSELLSEAKKLNDSQAPK

SEQ ID NO: 1312 - protein, 58 aa, ARTIFICIAL SEQUENCE
  Engineered IL-1R-I binding polypeptide
VDAKYAKEVEEIQMEIFDLPNLTRRQYTAFIRKLLDDPSQSSELLSEAKKLNDSQAPK

SEQ ID NO: 1313 - protein, 58 aa, ARTIFICIAL SEQUENCE
  Engineered IL-1R-I binding polypeptide
VDAKYAKELERIQMEIFHLPNLTRKQYTAFIRKLLDDPSQSSELLSEAKKLNDSQAPK

SEQ ID NO: 1314 - protein, 58 aa, ARTIFICIAL SEQUENCE
  Engineered IL-1R-I binding polypeptide
VDAKYAKEIEKVQMEIFHLPNLTRKQYTAFIRKLLDDPSQSSELLSEAKKLNDSQAPK

SEQ ID NO: 1315 - protein, 58 aa, ARTIFICIAL SEQUENCE
  Engineered IL-1R-I binding polypeptide
VDAKYAKELEKVQMEIFRLPNLTRRQYTAFIRKLLDDPSQSSELLSEAKKLNDSQAPK

SEQ ID NO: 1316 - protein, 58 aa, ARTIFICIAL SEQUENCE
  Engineered IL-1R-I binding polypeptide
VDAKYAKELEKVQMEIFHLPNLTRRQYTAFIRKLLDDPSQSSELLSEAKKLNDSQAPK

SEQ ID NO: 1317 - protein, 58 aa, ARTIFICIAL SEQUENCE
  Engineered IL-1R-I binding polypeptide
VDAKYAKEVEKIQMEIFRLPNLTRRQYTAFIRKLLDDPSQSSELLSEAKKLNDSQAPK

SEQ ID NO: 1318 - protein, 58 aa, ARTIFICIAL SEQUENCE
  Engineered IL-1R-I binding polypeptide
VDAKYAKETEKVQMEIFRLPNLTRRQYTAFIRKLLDDPSQSSELLSEAKKLNDSQAPK

SEQ ID NO: 1319 - protein, 58 aa, ARTIFICIAL SEQUENCE
  Engineered IL-1R-I binding polypeptide
VDAKYAKEIEEVQMEIFRLPNLTRKQYTAFIRKLLDDPSQSSELLSEAKKLNDSQAPK

SEQ ID NO: 1320 - protein, 58 aa, ARTIFICIAL SEQUENCE
  Engineered IL-1R-I binding polypeptide
VDAKYAKELEEVQMEIFRLPNLTRKQYTAFIRKLFDDPSQSSELLSEAKKLNDSQAPK

SEQ ID NO: 1321 - protein, 58 aa, ARTIFICIAL SEQUENCE
  Engineered IL-1R-I binding polypeptide
VDAKYAKEIEEIQMEIFRLPNLTRKQYTAFIRKLFDDPSQSSELLSEAKKLNDSQAPK

SEQ ID NO: 1322 - protein, 58 aa, ARTIFICIAL SEQUENCE
  Engineered IL-1R-I binding polypeptide
VDAKYAKEIEEIQMEIFHLPNLTRKQYTAFIRKLFDDPSQSSELLSEAKKLNDSQAPK

SEQ ID NO: 1323 - protein, 58 aa, ARTIFICIAL SEQUENCE
  Engineered IL-1R-I binding polypeptide
VDAKYAKELEEIQMEIFHLPNLTRKQYTAFIRKLLDDPSQSSELLSEAKKLNDSQAPK

SEQ ID NO: 1324 - protein, 58 aa, ARTIFICIAL SEQUENCE
  Engineered IL-1R-I binding polypeptide
VDAKYAKEIEEIQMEIFHLPNLTRKQYTAFIRKLLDDPSQSSELLSEAKKLNDSQAPK

SEQ ID NO: 1325 - protein, 58 aa, ARTIFICIAL SEQUENCE
  Engineered IL-1R-I binding polypeptide
VDAKYAKELETVQMEIFRLPNLTRRQYTAFIRKLLDDPSQSSELLSEAKKLNDSQAPK

SEQ ID NO: 1326 - protein, 58 aa, ARTIFICIAL SEQUENCE
  Engineered IL-1R-I binding polypeptide
VDAKYAKEIEQVQMEIFRLPNLTRRQYTAFIRKLLDDPSQSSELLSEAKKLNDSQAPK

SEQ ID NO: 1327 - protein, 58 aa, ARTIFICIAL SEQUENCE
  Engineered IL-1R-I binding polypeptide
VDAKYAKEIEQIQMEIFRLPNLTRRQYTAFIRKLLDDPSQSSELLSEAKKLNDSQAPK

SEQ ID NO: 1328 - protein, 58 aa, ARTIFICIAL SEQUENCE
  Engineered IL-1R-I binding polypeptide
VDAKYAKEIEEIQMEIFRLPNLTRRQYTAFIRKLLDDPSQSSELLSEAKKLNDSQAPK

SEQ ID NO: 1329 - protein, 58 aa, ARTIFICIAL SEQUENCE
  Engineered IL-1R-I binding polypeptide
VDAKYAKELEEIQMEIFRLPNLTRRQYTAFIRKLLDDPSQSSELLSEAKKLNDSQAPK

SEQ ID NO: 1330 - protein, 58 aa, ARTIFICIAL SEQUENCE
  Engineered IL-1R-I binding polypeptide
VDAKYAKELEEIQMEIFHLPNLTRRQYTAFIRKLLDDPSQSSELLSEAKKLNDSQAPK

SEQ ID NO: 1331 - protein, 58 aa, ARTIFICIAL SEQUENCE
  Engineered IL-1R-I binding polypeptide
VDAKYAKEIEEIQMEIFHLPNLTRRQYTAFIRKLLDDPSQSSELLSEAKKLNDSQAPK

SEQ ID NO: 1332 - protein, 58 aa, ARTIFICIAL SEQUENCE
  Engineered IL-1R-I binding polypeptide
VDAKYAKEVEEIQMEIFHLPNLTRKQYTAFIRKLFDDPSQSSELLSEAKKLNDSQAPK

SEQ ID NO: 1333 - protein, 58 aa, ARTIFICIAL SEQUENCE
  Engineered IL-1R-I binding polypeptide
VDAKYAKEVEEVQMEIFELPNLTRRQYTAFIRKLLDDPSQSSELLSEAKKLNDSQAPK

SEQ ID NO: 1334 - protein, 58 aa, ARTIFICIAL SEQUENCE
  Engineered IL-1R-I binding polypeptide
VDAKYAKEVEEIQMEIFELPNLTRRQYTAFIRKLLDDPSQSSELLSEAKKLNDSQAPK

SEQ ID NO: 1335 - protein, 58 aa, ARTIFICIAL SEQUENCE
  Engineered IL-1R-I binding polypeptide
VDAKYAKEVEQVQMEIFHLPNLTRRQYTAFIRKLLDDPSQSSELLSEAKKLNDSQAPK

SEQ ID NO: 1336 - protein, 58 aa, ARTIFICIAL SEQUENCE
  Engineered IL-1R-I binding polypeptide
VDAKYAKEVEQIQMEIFHLPNLTRKQYTAFIRKLLDDPSQSSELLSEAKKLNDSQAPK

SEQ ID NO: 1337 - protein, 58 aa, ARTIFICIAL SEQUENCE
  Engineered IL-1R-I binding polypeptide
VDAKYAKEVEEIQMEIFHLPNLTRKQYTAFIRKLLDDPSQSSELLSEAKKLNDSQAPK

SEQ ID NO: 1338 - protein, 58 aa, ARTIFICIAL SEQUENCE
  Engineered IL-1R-I binding polypeptide
VDAKYAKEVEEVQMEIFHLPNLTRKQYTAFIRKLLDDPSQSSELLSEAKKLNDSQAPK

SEQ ID NO: 1339 - protein, 58 aa, ARTIFICIAL SEQUENCE
  Engineered IL-1R-I binding polypeptide
VDAKYAKEVEEVQMEIFHLPNLTRRQYTAFIRKLLDDPSQSSELLSEAKKLNDSQAPK

SEQ ID NO: 1340 - protein, 58 aa, ARTIFICIAL SEQUENCE
  Engineered IL-1R-I binding polypeptide
VDAKYAKEVEEIQMEIFHLPNLTRRQYTAFIRKLLDDPSQSSELLSEAKKLNDSQAPK

SEQ ID NO: 1341 - protein, 58 aa, ARTIFICIAL SEQUENCE
  Engineered IL-1R-I binding polypeptide
VDAKYAKEVEEIQMEIFRLPNLTRKQYTAFIRKLLDDPSQSSELLSEAKKLNDSQAPK

SEQ ID NO: 1342 - protein, 58 aa, ARTIFICIAL SEQUENCE
  Engineered IL-1R-I binding polypeptide
VDAKYAKEVEEVQMEIFRLPNLTRKQYTAFIRKLLDDPSQSSELLSEAKKLNDSQAPK

SEQ ID NO: 1343 - protein, 58 aa, ARTIFICIAL SEQUENCE
  Engineered IL-1R-I binding polypeptide
VDAKYAKEVEEIQMEIFRLPNLTRRQYTAFIRKLFDDPSQSSELLSEAKKLNDSQAPK

SEQ ID NO: 1344 - protein, 58 aa, ARTIFICIAL SEQUENCE
  Engineered IL-1R-I binding polypeptide
VDAKYAKEVEEVQMEIFRLPNLTRRQYTAFIRKLLDDPSQSSELLSEAKKLNDSQAPK

SEQ ID NO: 1345 - protein, 58 aa, ARTIFICIAL SEQUENCE
  Engineered IL-1R-I binding polypeptide
VDAKYAKEVERIQMEIFSLPNLTRKQYTAFIRKLLDDPSQSSELLSEAKKLNDSQAPK

SEQ ID NO: 1346 - protein, 58 aa, ARTIFICIAL SEQUENCE
  Engineered IL-1R-I binding polypeptide
VDAKYAKEVEKIQMEIFSLPNLTRKQYTAFIRKLFDDPSQSSELLSEAKKLNDSQAPK

SEQ ID NO: 1347 - protein, 58 aa, ARTIFICIAL SEQUENCE
  Engineered IL-1R-I binding polypeptide
VDAKYAKEIETVQMEIFSLPNLTRKQYTAFIRKLFDDPSQSSELLSEAKKLNDSQAPK

SEQ ID NO: 1348 - protein, 58 aa, ARTIFICIAL SEQUENCE
  Engineered IL-1R-I binding polypeptide
VDAKYAKELETVQMEIFSLPNLTRKQYTAFIRKLLDDPSQSSELLSEAKKLNDSQAPK

SEQ ID NO: 1349 - protein, 58 aa, ARTIFICIAL SEQUENCE
  Engineered IL-1R-I binding polypeptide
VDAKYAKELEEIQMEIFSLPNLTRRQYTAFIRKLLDDPSQSSELLSEAKKLNDSQAPK

SEQ ID NO: 1350 - protein, 58 aa, ARTIFICIAL SEQUENCE
  Engineered IL-1R-I binding polypeptide
VDAKYAKEVEEIQMEIFSLPNLTRKQYTAFIRKLLDDPSQSSELLSEAKKLNDSQAPK

SEQ ID NO: 1351 - protein, 58 aa, ARTIFICIAL SEQUENCE
  Engineered IL-1R-I binding polypeptide
VDAKYAKELETVQMEIFGLPNLTRRQYTAFIRKLLDDPSQSSELLSEAKKLNDSQAPK

SEQ ID NO: 1352 - protein, 58 aa, ARTIFICIAL SEQUENCE
  Engineered IL-1R-I binding polypeptide
VDAKYAKELEKVQMEIFGLPNLTRRQYTAFIRKLLDDPSQSSELLSEAKKLNDSQAPK

SEQ ID NO: 1353 - protein, 58 aa, ARTIFICIAL SEQUENCE
  Engineered IL-1R-I binding polypeptide
VDAKYAKEIEEIQMEIFGLPNLTRKQYTAFIRKLLDDPSQSSELLSEAKKLNDSQAPK

SEQ ID NO: 1354 - protein, 58 aa, ARTIFICIAL SEQUENCE
  Engineered IL-1R-I binding polypeptide
VDAKYAKELEEVQMEIFGLPNLTRKQYTAFIRKLLDDPSQSSELLSEAKKLNDSQAPK

SEQ ID NO: 1355 - protein, 58 aa, ARTIFICIAL SEQUENCE
  Engineered IL-1R-I binding polypeptide
VDAKYAKEIEEIQMEIFGLPNLTRRQYTAFIRKLFDDPSQSSELLSEAKKLNDSQAPK

SEQ ID NO: 1356 - protein, 58 aa, ARTIFICIAL SEQUENCE
  Engineered IL-1R-I binding polypeptide
VDAKYAKEIEEIQMEIFGLPNLTRRQYTAFIRKLLDDPSQSSELLSEAKKLNDSQAPK

SEQ ID NO: 1357 - protein, 58 aa, ARTIFICIAL SEQUENCE
  Engineered IL-1R-I binding polypeptide
VDAKYAKEIEEVQMEIFGLPNLTRRQYTAFIRKLLDDPSQSSELLSEAKKLNDSQAPK

SEQ ID NO: 1358 - protein, 58 aa, ARTIFICIAL SEQUENCE
  Engineered IL-1R-I binding polypeptide
VDAKYAKEVEEIQMEIFGLPNLTRKQYTAFIRKLFDDPSQSSELLSEAKKLNDSQAPK

SEQ ID NO: 1359 - protein, 58 aa, ARTIFICIAL SEQUENCE
  Engineered IL-1R-I binding polypeptide
VDAKYAKEVEEIQMEIFGLPNLTRKQYTAFIRKLLDDPSQSSELLSEAKKLNDSQAPK

SEQ ID NO: 1360 - protein, 58 aa, ARTIFICIAL SEQUENCE
  Engineered IL-1R-I binding polypeptide
VDAKYAKEVEEVQMEIFGLPNLTRKQYTAFIRKLLDDPSQSSELLSEAKKLNDSQAPK

SEQ ID NO: 1361 - protein, 58 aa, ARTIFICIAL SEQUENCE
  Engineered IL-1R-I binding polypeptide
VDAKYAKEVEEIQMEIFGLPNLTRRQYTAFIRKLLDDPSQSSELLSEAKKLNDSQAPK

SEQ ID NO: 1362 - protein, 58 aa, ARTIFICIAL SEQUENCE
  Engineered IL-1R-I binding polypeptide
VDAKYAKEVEEVQMEIFGLPNLTRRQYTAFIRKLLDDPSQSSELLSEAKKLNDSQAPK

SEQ ID NO: 1363 - protein, 58 aa, ARTIFICIAL SEQUENCE
  Engineered IL-1R-I binding polypeptide
VDAKYAKETEEVQMEIFALPNLTRKQYTAFIRKLLDDPSQSSELLSEAKKLNDSQAPK

SEQ ID NO: 1364 - protein, 58 aa, ARTIFICIAL SEQUENCE
  Engineered IL-1R-I binding polypeptide
VDAKYAKETEEVQMEIFALPNLTRRQYTAFIRKLLDDPSQSSELLSEAKKLNDSQAPK

SEQ ID NO: 1365 - protein, 58 aa, ARTIFICIAL SEQUENCE
  Engineered IL-1R-I binding polypeptide
VDAKYAKEIEQIQMEIFALPNLTRRQYTAFIRKLLDDPSQSSELLSEAKKLNDSQAPK

SEQ ID NO: 1366 - protein, 58 aa, ARTIFICIAL SEQUENCE
  Engineered IL-1R-I binding polypeptide
VDAKYAKEIEEVQMEIFALPNLTRRQYTAFIRKLLDDPSQSSELLSEAKKLNDSQAPK

SEQ ID NO: 1367 - protein, 58 aa, ARTIFICIAL SEQUENCE
  Engineered IL-1R-I binding polypeptide
VDAKYAKEIEEIQMEIFALPNLTRRQYTAFIRKLLDDPSQSSELLSEAKKLNDSQAPK

SEQ ID NO: 1368 - protein, 58 aa, ARTIFICIAL SEQUENCE
  Engineered IL-1R-I binding polypeptide
VDAKYAKEVEEIQMEIFALPNLTRRQYTAFIRKLLDDPSQSSELLSEAKKLNDSQAPK

SEQ ID NO: 1369 - protein, 58 aa, ARTIFICIAL SEQUENCE
  Engineered IL-1R-I binding polypeptide
VDAKYAKEVEEVQMEIFALPNLTRRQYTAFIRKLLDDPSQSSELLSEAKKLNDSQAPK

SEQ ID NO: 1370 - protein, 58 aa, ARTIFICIAL SEQUENCE
  Engineered IL-1R-I binding polypeptide
VDAKYAKEIEQIQMEIFALPNLTRKQYTAFIRKLLDDPSQSSELLSEAKKLNDSQAPK

SEQ ID NO: 1371 - protein, 58 aa, ARTIFICIAL SEQUENCE
  Engineered IL-1R-I binding polypeptide
VDAKYAKEIEQVQMEIFALPNLTRKQYTAFIRKLFDDPSQSSELLSEAKKLNDSQAPK

SEQ ID NO: 1372 - protein, 58 aa, ARTIFICIAL SEQUENCE
  Engineered IL-1R-I binding polypeptide
VDAKYAKEIEEIQMEIFALPNLTRKQYTAFIRKLLDDPSQSSELLSEAKKLNDSQAPK

SEQ ID NO: 1373 - protein, 58 aa, ARTIFICIAL SEQUENCE
  Engineered IL-1R-I binding polypeptide
VDAKYAKEIEEVQMEIFALPNLTRKQYTAFIRKLLDDPSQSSELLSEAKKLNDSQAPK

SEQ ID NO: 1374 - protein, 58 aa, ARTIFICIAL SEQUENCE
  Engineered IL-1R-I binding polypeptide
VDAKYAKEIEEVQMEIFALPNLTRKQYTAFIRKLFDDPSQSSELLSEAKKLNDSQAPK

SEQ ID NO: 1375 - protein, 58 aa, ARTIFICIAL SEQUENCE
  Engineered IL-1R-I binding polypeptide
VDAKYAKEVEEIQMEIFALPNLTRKQYTAFIRKLFDDPSQSSELLSEAKKLNDSQAPK

SEQ ID NO: 1376 - protein, 58 aa, ARTIFICIAL SEQUENCE
  Engineered IL-1R-I binding polypeptide
VDAKYAKETEIVQMEIFHLPNLTRKQYTAFIRKLLDDPSQSSELLSEAKKLNDSQAPK

SEQ ID NO: 1377 - protein, 58 aa, ARTIFICIAL SEQUENCE
  Engineered IL-1R-I binding polypeptide
VDAKYAKETEVVQMEIFHLPNLTRKQYTAFIRKLLDDPSQSSELLSEAKKLNDSQAPK

SEQ ID NO: 1378 - protein, 58 aa, ARTIFICIAL SEQUENCE
  Engineered IL-1R-I binding polypeptide
VDAKYAKETEIVQMEIFGLPNLTRKQYTAFIRKLLDDPSQSSELLSEAKKLNDSQAPK

SEQ ID NO: 1379 - protein, 58 aa, ARTIFICIAL SEQUENCE
  Engineered IL-1R-I binding polypeptide
VDAKYAKEIEIIQMEIFYLPNLTRKQYTAFIRKLLDDPSQSSELLSEAKKLNDSQAPK

SEQ ID NO: 1380 - protein, 58 aa, ARTIFICIAL SEQUENCE
  Engineered IL-1R-I binding polypeptide
VDAKYAKEIEYIQMEIFYLPNLTRRQYTAFIRKLLDDPSQSSELLSEAKKLNDSQAPK

SEQ ID NO: 1381 - protein, 58 aa, ARTIFICIAL SEQUENCE
  Engineered IL-1R-I binding polypeptide
VDAKYAKEIEVVQMEIFYLPNLTRRQYTAFIRKLLDDPSQSSELLSEAKKLNDSQAPK

SEQ ID NO: 1382 - protein, 58 aa, ARTIFICIAL SEQUENCE
  Engineered IL-1R-I binding polypeptide
VDAKYAKELEVIQMEIFELPNLTRRQYTAFIRKLLDDPSQSSELLSEAKKLNDSQAPK

SEQ ID NO: 1383 - protein, 58 aa, ARTIFICIAL SEQUENCE
  Engineered IL-1R-I binding polypeptide
VDAKYAKEVEVIQMEIFHLPNLTRKQYTAFIRKLLDDPSQSSELLSEAKKLNDSQAPK

SEQ ID NO: 1384 - protein, 58 aa, ARTIFICIAL SEQUENCE
  Engineered IL-1R-I binding polypeptide
VDAKYAKEVEVIQMEIFRLPNLTRKQYTAFIRKLLDDPSQSSELLSEAKKLNDSQAPK

SEQ ID NO: 1385 - protein, 58 aa, ARTIFICIAL SEQUENCE
  Engineered IL-1R-I binding polypeptide
VDAKYAKEVEVVQMEIFRLPNLTRKQYTAFIRKLLDDPSQSSELLSEAKKLNDSQAPK

SEQ ID NO: 1386 - protein, 58 aa, ARTIFICIAL SEQUENCE
  Engineered IL-1R-I binding polypeptide
VDAKYAKEVEVIQMEIFRLPNLTRRQYTAFIRKLLDDPSQSSELLSEAKKLNDSQAPK

SEQ ID NO: 1387 - protein, 58 aa, ARTIFICIAL SEQUENCE
  Engineered IL-1R-I binding polypeptide
VDAKYAKELEVIQMEIFKLPNLTRKQYTAFIRKLLDDPSQSSELLSEAKKLNDSQAPK

SEQ ID NO: 1388 - protein, 58 aa, ARTIFICIAL SEQUENCE
  Engineered IL-1R-I binding polypeptide
VDAKYAKEIEVVQMEIFHLPNLTRKQYTAFIRKLLDDPSQSSELLSEAKKLNDSQAPK

SEQ ID NO: 1389 - protein, 58 aa, ARTIFICIAL SEQUENCE
  Engineered IL-1R-I binding polypeptide
VDAKYAKEIEVIQMEIFRLPNLTRKQYTAFIRKLLDDPSQSSELLSEAKKLNDSQAPK

SEQ ID NO: 1390 - protein, 58 aa, ARTIFICIAL SEQUENCE
  Engineered IL-1R-I binding polypeptide
VDAKYAKEVEYIQMEIFRLPNLTRRQYTAFIRKLLDDPSQSSELLSEAKKLNDSQAPK

SEQ ID NO: 1391 - protein, 58 aa, ARTIFICIAL SEQUENCE
  Engineered IL-1R-I binding polypeptide
VDAKYAKELEIVQMEIFHLPNLTRRQYTAFIRKLLDDPSQSSELLSEAKKLNDSQAPK

SEQ ID NO: 1392 - protein, 58 aa, ARTIFICIAL SEQUENCE
  Engineered IL-1R-I binding polypeptide
VDAKYAKELEIIQMEIFHLPNLTRRQYTAFIRKLLDDPSQSSELLSEAKKLNDSQAPK

SEQ ID NO: 1393 - protein, 58 aa, ARTIFICIAL SEQUENCE
  Engineered IL-1R-I binding polypeptide
VDAKYAKEVEIIQMEIFHLPNLTRRQYTAFIRKLLDDPSQSSELLSEAKKLNDSQAPK

SEQ ID NO: 1394 - protein, 58 aa, ARTIFICIAL SEQUENCE
  Engineered IL-1R-I binding polypeptide
VDAKYAKELEVIQMEIFALPNLTRKQYTAFIRKLLDDPSQSSELLSEAKKLNDSQAPK

SEQ ID NO: 1395 - protein, 58 aa, ARTIFICIAL SEQUENCE
  Engineered IL-1R-I binding polypeptide
VDAKYAKELEVIQMEIFALPNLTRKQYTAFIRKLFDDPSQSSELLSEAKKLNDSQAPK

SEQ ID NO: 1396 - protein, 58 aa, ARTIFICIAL SEQUENCE
  Engineered IL-1R-I binding polypeptide
VDAKYAKEVEIIQMEIFALPNLTRKQYTAFIRKLFDDPSQSSELLSEAKKLNDSQAPK

SEQ ID NO: 1397 - protein, 58 aa, ARTIFICIAL SEQUENCE
  Engineered IL-1R-I binding polypeptide
VDAKYAKEVEIIQMEIFALPNLTRKQYTAFIRKLLDDPSQSSELLSEAKKLNDSQAPK

SEQ ID NO: 1398 - protein, 58 aa, ARTIFICIAL SEQUENCE
  Engineered IL-1R-I binding polypeptide
VDAKYAKEVEVIQMEIFSLPNLTRKQYTAFIRKLLDDPSQSSELLSEAKKLNDSQAPK

SEQ ID NO: 1399 - protein, 58 aa, ARTIFICIAL SEQUENCE
  Engineered IL-1R-I binding polypeptide
VDAKYAKEVEVVQMEIFSLPNLTRKQYTAFIRKLLDDPSQSSELLSEAKKLNDSQAPK

SEQ ID NO: 1400 - protein, 58 aa, ARTIFICIAL SEQUENCE
  Engineered IL-1R-I binding polypeptide
VDAKYAKELEIVQMEIFSLPNLTRRQYTAFIRKLLDDPSQSSELLSEAKKLNDSQAPK

SEQ ID NO: 1401 - protein, 58 aa, ARTIFICIAL SEQUENCE
  Engineered IL-1R-I binding polypeptide
VDAKYAKEIEYIQMEIFGLPNLTRRQYTAFIRKLLDDPSQSSELLSEAKKLNDSQAPK

SEQ ID NO: 1402 - protein, 58 aa, ARTIFICIAL SEQUENCE
  Engineered IL-1R-I binding polypeptide
VDAKYAKEVEVIQMEIFGLPNLTRRQYTAFIRKLLDDPSQSSELLSEAKKLNDSQAPK

SEQ ID NO: 1403 - protein, 58 aa, ARTIFICIAL SEQUENCE
  Engineered IL-1R-I binding polypeptide
VDAKYAKEVEIIQMEIFGLPNLTRRQYTAFIRKLLDDPSQSSELLSEAKKLNDSQAPK

SEQ ID NO: 1404 - protein, 58 aa, ARTIFICIAL SEQUENCE
  Engineered IL-1R-I binding polypeptide
VDAKYAKEVETVQMEIFRLPNLTRKQYTAFIRKLLDDPSQSSELLSEAKKLNDSQAPK

SEQ ID NO: 1405 - protein, 58 aa, ARTIFICIAL SEQUENCE
  Engineered IL-1R-I binding polypeptide
VDAKYAKELETVQMEIFHLPNLTRKQYTAFIRKLLDDPSQSSELLSEAKKLNDSQAPK

SEQ ID NO: 1406 - protein, 58 aa, ARTIFICIAL SEQUENCE
  Engineered IL-1R-I binding polypeptide
VDAKYAKELEAIQMEIFTLPNLTRRQYTAFIRKLLDDPSQSSELLSEAKKLNDSQAPK

SEQ ID NO: 1407 - protein, 58 aa, ARTIFICIAL SEQUENCE
  Engineered IL-1R-I binding polypeptide
VDAKYAKEIEAIQMEIYYLPNLTRRQYTAFIRKLLDDPSQSSELLSEAKKLNDSQAPK

SEQ ID NO: 1408 - protein, 58 aa, ARTIFICIAL SEQUENCE
  Engineered IL-1R-I binding polypeptide
VDAKYAKELEAIQMEIFYLPNLTRRQYTAFIRKLLDDPSQSSELLSEAKKLNDSQAPK

SEQ ID NO: 1409 - protein, 58 aa, ARTIFICIAL SEQUENCE
  Engineered IL-1R-I binding polypeptide
VDAKYAKELEAVQMEIFYLPNLTRRQYTAFIRKLLDDPSQSSELLSEAKKLNDSQAPK

SEQ ID NO: 1410 - protein, 58 aa, ARTIFICIAL SEQUENCE
  Engineered IL-1R-I binding polypeptide
VDAKYAKEIEAVQMEIFYLPNLTRRQYTAFIRKLLDDPSQSSELLSEAKKLNDSQAPK

SEQ ID NO: 1411 - protein, 58 aa, ARTIFICIAL SEQUENCE
  Engineered IL-1R-I binding polypeptide
VDAKYAKEIEAIQMEIFYLPNLTRRQYTAFIRKLLDDPSQSSELLSEAKKLNDSQAPK

SEQ ID NO: 1412 - protein, 58 aa, ARTIFICIAL SEQUENCE
  Engineered IL-1R-I binding polypeptide
VDAKYAKEIEAIQMEIFFLPNLTRKQYTAFIRKLLDDPSQSSELLSEAKKLNDSQAPK

SEQ ID NO: 1413 - protein, 58 aa, ARTIFICIAL SEQUENCE
  Engineered IL-1R-I binding polypeptide
VDAKYAKEIEAIQMEIFFLPNLTRRQYTAFIRKLLDDPSQSSELLSEAKKLNDSQAPK

SEQ ID NO: 1414 - protein, 58 aa, ARTIFICIAL SEQUENCE
  Engineered IL-1R-I binding polypeptide
VDAKYAKEIEAIQMEIFYLPNLTRKQYTAFIRKLLDDPSQSSELLSEAKKLNDSQAPK

SEQ ID NO: 1415 - protein, 58 aa, ARTIFICIAL SEQUENCE
  Engineered IL-1R-I binding polypeptide
VDAKYAKELEAIQMEIFRLPNLTRRQYTAFIRKLLDDPSQSSELLSEAKKLNDSQAPK

SEQ ID NO: 1416 - protein, 58 aa, ARTIFICIAL SEQUENCE
  Engineered IL-1R-I binding polypeptide
VDAKYAKEIEAIQMEIFRLPNLTRKQYTAFIRKLLDDPSQSSELLSEAKKLNDSQAPK

SEQ ID NO: 1417 - protein, 58 aa, ARTIFICIAL SEQUENCE
  Engineered IL-1R-I binding polypeptide
VDAKYAKELEAIQMEIFRLPNLTRKQYTAFIRKLLDDPSQSSELLSEAKKLNDSQAPK

SEQ ID NO: 1418 - protein, 58 aa, ARTIFICIAL SEQUENCE
  Engineered IL-1R-I binding polypeptide
VDAKYAKEVEAIQMEIFHLPNLTRRQYTAFIRKLLDDPSQSSELLSEAKKLNDSQAPK

SEQ ID NO: 1419 - protein, 58 aa, ARTIFICIAL SEQUENCE
  Engineered IL-1R-I binding polypeptide
VDAKYAKEIEAVQMEIFHLPNLTRKQYTAFIRKLLDDPSQSSELLSEAKKLNDSQAPK

SEQ ID NO: 1420 - protein, 58 aa, ARTIFICIAL SEQUENCE
  Engineered IL-1R-I binding polypeptide
VDAKYAKEIEAIQMEIFHLPNLTRRQYTAFIRKLLDDPSQSSELLSEAKKLNDSQAPK

SEQ ID NO: 1421 - protein, 58 aa, ARTIFICIAL SEQUENCE
  Engineered IL-1R-I binding polypeptide
VDAKYAKELEAIQMEIFHLPNLTRRQYTAFIRKLLDDPSQSSELLSEAKKLNDSQAPK

SEQ ID NO: 1422 - protein, 58 aa, ARTIFICIAL SEQUENCE
  Engineered IL-1R-I binding polypeptide
VDAKYAKEVEAIQMEIFHLPNLTRKQYTAFIRKLLDDPSQSSELLSEAKKLNDSQAPK

SEQ ID NO: 1423 - protein, 58 aa, ARTIFICIAL SEQUENCE
  Engineered IL-1R-I binding polypeptide
VDAKYAKEVEAIQMEIFHLPNLTRKQYTAFIRKLFDDPSQSSELLSEAKKLNDSQAPK

SEQ ID NO: 1424 - protein, 58 aa, ARTIFICIAL SEQUENCE
  Engineered IL-1R-I binding polypeptide
VDAKYAKEVEAVQMEIFSLPNLTRRQYTAFIRKLLDDPSQSSELLSEAKKLNDSQAPK

SEQ ID NO: 1425 - protein, 58 aa, ARTIFICIAL SEQUENCE
  Engineered IL-1R-I binding polypeptide
VDAKYAKEIEAVQMEIFSLPNLTRRQYTAFIRKLLDDPSQSSELLSEAKKLNDSQAPK

SEQ ID NO: 1426 - protein, 58 aa, ARTIFICIAL SEQUENCE
  Engineered IL-1R-I binding polypeptide
VDAKYAKELEAIQMEIFSLPNLTRRQYTAFIRKLLDDPSQSSELLSEAKKLNDSQAPK

SEQ ID NO: 1427 - protein, 58 aa, ARTIFICIAL SEQUENCE
  Engineered IL-1R-I binding polypeptide
VDAKYAKEIEAVQMEIFSLPNLTRKQYTAFIRKLLDDPSQSSELLSEAKKLNDSQAPK

SEQ ID NO: 1428 - protein, 58 aa, ARTIFICIAL SEQUENCE
  Engineered IL-1R-I binding polypeptide
VDAKYAKEIEAIQMEIFGLPNLTRRQYTAFIRKLFDDPSQSSELLSEAKKLNDSQAPK

SEQ ID NO: 1429 - protein, 58 aa, ARTIFICIAL SEQUENCE
  Engineered IL-1R-I binding polypeptide
VDAKYAKEVEAIQMEIFGLPNLTRKQYTAFIRKLLDDPSQSSELLSEAKKLNDSQAPK

SEQ ID NO: 1430 - protein, 58 aa, ARTIFICIAL SEQUENCE
  Engineered IL-1R-I binding polypeptide
VDAKYAKEVEAIQMEIFGLPNLTRRQYTAFIRKLLDDPSQSSELLSEAKKLNDSQAPK

SEQ ID NO: 1431 - protein, 58 aa, ARTIFICIAL SEQUENCE
  Engineered IL-1R-I binding polypeptide
VDAKYAKEIEAVQMEIFGLPNLTRKQYTAFIRKLLDDPSQSSELLSEAKKLNDSQAPK

SEQ ID NO: 1432 - protein, 58 aa, ARTIFICIAL SEQUENCE
  Engineered IL-1R-I binding polypeptide
VDAKYAKEIEAIQMEIFGLPNLTRKQYTAFIRKLLDDPSQSSELLSEAKKLNDSQAPK

SEQ ID NO: 1433 - protein, 58 aa, ARTIFICIAL SEQUENCE
  Engineered IL-1R-I binding polypeptide
VDAKYAKETEAIQMEIFALPNLTRKQYTAFIRKLLDDPSQSSELLSEAKKLNDSQAPK

SEQ ID NO: 1434 - protein, 58 aa, ARTIFICIAL SEQUENCE
  Engineered IL-1R-I binding polypeptide
VDAKYAKETEAVQMEIFALPNLTRKQYTAFIRKLLDDPSQSSELLSEAKKLNDSQAPK

SEQ ID NO: 1435 - protein, 58 aa, ARTIFICIAL SEQUENCE
  Engineered IL-1R-I binding polypeptide
VDAKYAKETEAVQMEIFALPNLTRRQYTAFIRKLLDDPSQSSELLSEAKKLNDSQAPK

SEQ ID NO: 1436 - protein, 58 aa, ARTIFICIAL SEQUENCE
  Engineered IL-1R-I binding polypeptide
VDAKYAKETEAIQMEIFALPNLTRRQYTAFIRKLLDDPSQSSELLSEAKKLNDSQAPK

SEQ ID NO: 1437 - protein, 58 aa, ARTIFICIAL SEQUENCE
  Engineered IL-1R-I binding polypeptide
VDAKYAKEIEAVQMEIFALPNLTRKQYTAFIRKLFDDPSQSSELLSEAKKLNDSQAPK

SEQ ID NO: 1438 - protein, 58 aa, ARTIFICIAL SEQUENCE
  Engineered IL-1R-I binding polypeptide
VDAKYAKEIEAIQMEIFALPNLTRRQYTAFIRKLLDDPSQSSELLSEAKKLNDSQAPK

SEQ ID NO: 1439 - protein, 58 aa, ARTIFICIAL SEQUENCE
  Engineered IL-1R-I binding polypeptide
VDAKYAKEVEAVQMEIFALPNLTRRQYTAFIRKLLDDPSQSSELLSEAKKLNDSQAPK

SEQ ID NO: 1440 - protein, 58 aa, ARTIFICIAL SEQUENCE
  Engineered IL-1R-I binding polypeptide
VDAKYAKEVEAVQMEIFALPNLTRKQYTAFIRKLLDDPSQSSELLSEAKKLNDSQAPK

SEQ ID NO: 1441 - protein, 58 aa, ARTIFICIAL SEQUENCE
  Engineered IL-1R-I binding polypeptide
VDAKYAKEVEAIQMEIFALPNLTRKQYTAFIRKLLDDPSQSSELLSEAKKLNDSQAPK

SEQ ID NO: 1442 - protein, 58 aa, ARTIFICIAL SEQUENCE
  Engineered IL-1R-I binding polypeptide
VDAKYAKEVVKIYFEIYDLPNLTRKQYTAFIRKLLDDPSQSSELLSEAKKLNDSQAPK

SEQ ID NO: 1443 - protein, 58 aa, ARTIFICIAL SEQUENCE
  Engineered IL-1R-I binding polypeptide
VDAKYAKEVIDVYFEIYYLPNLTRKQYTAFIRKLLDDPSQSSELLSEAKKLNDSQAPK

SEQ ID NO: 1444 - protein, 58 aa, ARTIFICIAL SEQUENCE
  Engineered IL-1R-I binding polypeptide
VDAKYAKEVVHIYFEIFGLPNLTRRQYTAFIRKLLDDPSQSSELLSEAKKLNDSQAPK

SEQ ID NO: 1445 - protein, 58 aa, ARTIFICIAL SEQUENCE
  Engineered IL-1R-I binding polypeptide
VDAKYAKEVVEVYFEIFYLPNLTRRQYTAFIRKLLDDPSQSSELLSEAKKLNDSQAPK

SEQ ID NO: 1446 - protein, 58 aa, ARTIFICIAL SEQUENCE
  Engineered IL-1R-I binding polypeptide
VDAKYAKEVVEIYFEIFALPNLTRRQYTAFIRKLLDDPSQSSELLSEAKKLNDSQAPK

SEQ ID NO: 1447 - protein, 58 aa, ARTIFICIAL SEQUENCE
  Engineered IL-1R-I binding polypeptide
VDAKYAKEVVEVYFEIFALPNLTRKQYTAFIRKLLDDPSQSSELLSEAKKLNDSQAPK

SEQ ID NO: 1448 - protein, 58 aa, ARTIFICIAL SEQUENCE
  Engineered IL-1R-I binding polypeptide
VDAKYAKEIERIYFEIYGLPNLTRKQYTAFIRKLLDDPSQSSELLSEAKKLNDSQAPK

SEQ ID NO: 1449 - protein, 58 aa, ARTIFICIAL SEQUENCE
  Engineered IL-1R-I binding polypeptide
VDAKYAKEIEKIYFEIYDLPNLTRKQYTAFIRKLLDDPSQSSELLSEAKKLNDSQAPK

SEQ ID NO: 1450 - protein, 58 aa, ARTIFICIAL SEQUENCE
  Engineered IL-1R-I binding polypeptide
VDAKYAKEIEKVYFEIYDLPNLTRRQYTAFIRKLLDDPSQSSELLSEAKKLNDSQAPK

SEQ ID NO: 1451 - protein, 58 aa, ARTIFICIAL SEQUENCE
  Engineered IL-1R-I binding polypeptide
VDAKYAKEVEKIYYEIYELPNLTRKQYTAFIRKLLDDPSQSSELLSEAKKLNDSQAPK

SEQ ID NO: 1452 - protein, 58 aa, ARTIFICIAL SEQUENCE
  Engineered IL-1R-I binding polypeptide
VDAKYAKETEHVYFEIYQLPNLTRKQYTAFIRKLLDDPSQSSELLSEAKKLNDSQAPK

SEQ ID NO: 1453 - protein, 58 aa, ARTIFICIAL SEQUENCE
  Engineered IL-1R-I binding polypeptide
VDAKYAKETEKAYYEIYDLPNLTRKQYTAFIRKLLDDPSQSSELLSEAKKLNDSQAPK

SEQ ID NO: 1454 - protein, 58 aa, ARTIFICIAL SEQUENCE
  Engineered IL-1R-I binding polypeptide
VDAKYAKETERVYYEIYSLPNLTRKQYTAFIRKLLDDPSQSSELLSEAKKLNDSQAPK

SEQ ID NO: 1455 - protein, 58 aa, ARTIFICIAL SEQUENCE
  Engineered IL-1R-I binding polypeptide
VDAKYAKETEIVYFEIFGLPNLTRKQYTAFIRKLLDDPSQSSELLSEAKKLNDSQAPK

SEQ ID NO: 1456 - protein, 58 aa, ARTIFICIAL SEQUENCE
  Engineered IL-1R-I binding polypeptide
VDAKYAKEVEFAYWEIYALPNLTRKQYTAFIRKLLDDPSQSSELLSEAKKLNDSQAPK

SEQ ID NO: 1457 - protein, 58 aa, ARTIFICIAL SEQUENCE
  Engineered IL-1R-I binding polypeptide
VDAKYAKEVEVVYFEIFALPNLTRKQYTAFIRKLLDDPSQSSELLSEAKKLNDSQAPK

SEQ ID NO: 1458 - protein, 58 aa, ARTIFICIAL SEQUENCE
  Engineered IL-1R-I binding polypeptide
VDAKYAKEVESAYFEIYDLPNLTRKQYTAFIRKLLDDPSQSSELLSEAKKLNDSQAPK

SEQ ID NO: 1459 - protein, 58 aa, ARTIFICIAL SEQUENCE
  Engineered IL-1R-I binding polypeptide
VDAKYAKEVEAVYYEIYQLPNLTRKQYTAFIRKLLDDPSQSSELLSEAKKLNDSQAPK

SEQ ID NO: 1460 - protein, 58 aa, ARTIFICIAL SEQUENCE; identical to SEQ ID NO: 969
  Engineered IL-1R-I binding polypeptide

SEQ ID NO: 1461 - protein, 58 aa, ARTIFICIAL SEQUENCE
  Engineered IL-1R-I binding polypeptide
VDAKYAKEVEDVYFEIFELPNLTRRQYTAFIRKLLDDPSQSSELLSEAKKLNDSQAPK

SEQ ID NO: 1462 - protein, 58 aa, ARTIFICIAL SEQUENCE
  Engineered IL-1R-I binding polypeptide
VDAKYAKEVETVYYEIFKLPNLTRRQYTAFIRKLLDDPSQSSELLSEAKKLNDSQAPK

SEQ ID NO: 1463 - protein, 58 aa, ARTIFICIAL SEQUENCE
  Engineered IL-1R-I binding polypeptide
VDAKYAKEVEQVYFEIYFLPNLTRKQYTAFIRKLLDDPSQSSELLSEAKKLNDSQAPK

SEQ ID NO: 1464 - protein, 58 aa, ARTIFICIAL SEQUENCE
  Engineered IL-1R-I binding polypeptide
VDAKYAKEVEEIYQEIYRLPNLTRKQYTAFIRKLLDDPSQSSELLSEAKKLNDSQAPK

SEQ ID NO: 1465 - protein, 58 aa, ARTIFICIAL SEQUENCE
  Engineered IL-1R-I binding polypeptide
VDAKYAKEVEEIYFEIFGLPNLTRKQYTAFIRKLLDDPSQSSELLSEAKKLNDSQAPK

SEQ ID NO: 1466 - protein, 58 aa, ARTIFICIAL SEQUENCE
  Engineered IL-1R-I binding polypeptide
VDAKYAKELEAVQLEIFALPNLTRKQYTAFIIKLLDDPSQSSELLSEAKKLNDSQAPK

SEQ ID NO: 1467 - protein, 58 aa, ARTIFICIAL SEQUENCE
  Engineered IL-1R-I binding polypeptide
VDAKYAKEIEKIQLEIFALPNLTRKQYTAFIIKLFDDPSQSSELLSEAKKLNDSQAPK

SEQ ID NO: 1468 - protein, 58 aa, ARTIFICIAL SEQUENCE
  Engineered IL-1R-I binding polypeptide
VDAKYAKEVEEVQLEIFALPNLTRKQYTAFIIKLLDDPSQSSELLSEAKKLNDSQAPK

SEQ ID NO: 1469 - protein, 58 aa, ARTIFICIAL SEQUENCE
  Engineered IL-1R-I binding polypeptide
VDAKYAKEVEDVQLEIFALPNLTRKQYTAFIIKLFDDPSQSSELLSEAKKLNDSQAPK

SEQ ID NO: 1470 - protein, 58 aa, ARTIFICIAL SEQUENCE
  Engineered IL-1R-I binding polypeptide
VDAKYAKEIEQVQLEIYKLPNLTRKQYTAFIIKLFDDPSQSSELLSEAKKLNDSQAPK

SEQ ID NO: 1471 - protein, 58 aa, ARTIFICIAL SEQUENCE
  Engineered IL-1R-I binding polypeptide
VDAKYAKEVEEIQLEIFHLPNLTRRQYTAFIIKLLDDPSQSSELLSEAKKLNDSQAPK

SEQ ID NO: 1472 - protein, 58 aa, ARTIFICIAL SEQUENCE
  Engineered IL-1R-I binding polypeptide
VDAKYAKELEEVQLEIFRLPNLTRRQYTAFIIKLLDDPSQSSELLSEAKKLNDSQAPK

SEQ ID NO: 1473 - protein, 58 aa, ARTIFICIAL SEQUENCE
  Engineered IL-1R-I binding polypeptide
VDAKYAKEIEDVQHEIFGLPNLTRKQYTAFIRKLFDDPSQSSELLSEAKKLNDSQAPK

SEQ ID NO: 1474 - protein, 58 aa, ARTIFICIAL SEQUENCE
  Engineered IL-1R-I binding polypeptide
VDAKYAKEVEKVQQEIFGLPNLTRKQYTAFIRKLFDDPSQSSELLSEAKKLNDSQAPK

SEQ ID NO: 1475 - protein, 58 aa, ARTIFICIAL SEQUENCE
  Engineered IL-1R-I binding polypeptide
VDAKYAKEIEAIQHEIFALPNLTRKQYTAFIRKLFDDPSQSSELLSEAKKLNDSQAPK

SEQ ID NO: 1476 - protein, 58 aa, ARTIFICIAL SEQUENCE
  Engineered IL-1R-I binding polypeptide
VDAKYAKEIEAIQHEIFVLPNLTRKQYTAFIRKLLDDPSQSSELLSEAKKLNDSQAPK

SEQ ID NO: 1477 - protein, 58 aa, ARTIFICIAL SEQUENCE
  Engineered IL-1R-I binding polypeptide
VDAKYAKEIERIQHEIFALPNLTRKQYTAFIRKLLDDPSQSSELLSEAKKLNDSQAPK

SEQ ID NO: 1478 - protein, 58 aa, ARTIFICIAL SEQUENCE
  Engineered IL-1R-I binding polypeptide
VDAKYAKEIEVIQHEIFGLPNLTRKQYTAFIRKLLDDPSQSSELLSEAKKLNDSQAPK

SEQ ID NO: 1479 - protein, 58 aa, ARTIFICIAL SEQUENCE
  Engineered IL-1R-I binding polypeptide
VDAKYAKETEDIQQEIFQLPNLTRRQYTAFIRKLLDDPSQSSELLSEAKKLNDSQAPK

SEQ ID NO: 1480 - protein, 58 aa, ARTIFICIAL SEQUENCE
  Engineered IL-1R-I binding polypeptide
VDAKYAKEVESIQQEIFQLPNLTRKQYTAFIRKLLDDPSQSSELLSEAKKLNDSQAPK

SEQ ID NO: 1481 - protein, 58 aa, ARTIFICIAL SEQUENCE
  Engineered IL-1R-I binding polypeptide
VDAKYAKEVERIQQEIFHLPNLTRKQYTAFIRKLLDDPSQSSELLSEAKKLNDSQAPK

SEQ ID NO: 1482 - protein, 58 aa, ARTIFICIAL SEQUENCE
  Engineered IL-1R-I binding polypeptide
VDAKYAKEIEEIQQEIFHLPNLTRRQYTAFIRKLLDDPSQSSELLSEAKKLNDSQAPK

SEQ ID NO: 1483 - protein, 58 aa, ARTIFICIAL SEQUENCE
  Engineered IL-1R-I binding polypeptide
VDAKYAKEVETIQHEIFRLPNLTRKQYTAFIRKLFDDPSQSSELLSEAKKLNDSQAPK

SEQ ID NO: 1484 - protein, 58 aa, ARTIFICIAL SEQUENCE
  Engineered IL-1R-I binding polypeptide
VDAKYAKETEVVQFEIFRLPNLTRRQYTAFIRKLFDDPSQSSELLSEAKKLNDSQAPK

SEQ ID NO: 1485 - protein, 58 aa, ARTIFICIAL SEQUENCE
  Engineered IL-1R-I binding polypeptide
VDAKYAKETEAVQLEIFELPNLTRKQYTAFIRKLLDDPSQSSELLSEAKKLNDSQAPK

SEQ ID NO: 1486 - protein, 58 aa, ARTIFICIAL SEQUENCE
  Engineered IL-1R-I binding polypeptide
VDAKYAKETEDVQLEIFRLPNLTRKQYTAFIRKLLDDPSQSSELLSEAKKLNDSQAPK

SEQ ID NO: 1487 - protein, 58 aa, ARTIFICIAL SEQUENCE
  Engineered IL-1R-I binding polypeptide
VDAKYAKEAEKIQFEIFSLPNLTRRQYTAFIRKLLDDPSQSSELLSEAKKLNDSQAPK

SEQ ID NO: 1488 - protein, 58 aa, ARTIFICIAL SEQUENCE
  Engineered IL-1R-I binding polypeptide
VDAKYAKETEEIQLEIYSLPNLTRRQYTAFIRKLLDDPSQSSELLSEAKKLNDSQAPK

SEQ ID NO: 1489 - protein, 58 aa, ARTIFICIAL SEQUENCE
  Engineered IL-1R-I binding polypeptide
VDAKYAKETEEIQLEIFSLPNLTRKQYTAFIRKLLDDPSQSSELLSEAKKLNDSQAPK

SEQ ID NO: 1490 - protein, 58 aa, ARTIFICIAL SEQUENCE
  Engineered IL-1R-I binding polypeptide
VDAKYAKETEKIQYEIFSLPNLTRRQYTAFIRKLLDDPSQSSELLSEAKKLNDSQAPK

SEQ ID NO: 1491 - protein, 58 aa, ARTIFICIAL SEQUENCE
  Engineered IL-1R-I binding polypeptide
VDAKYAKEIEQIQYEIFYLPNLTRKQYTAFIRKLLDDPSQSSELLSEAKKLNDSQAPK

SEQ ID NO: 1492 - protein, 58 aa, ARTIFICIAL SEQUENCE
  Engineered IL-1R-I binding polypeptide
VDAKYAKEIETVQYEIFYLPNLTRKQYTAFIRKLLDDPSQSSELLSEAKKLNDSQAPK

SEQ ID NO: 1493 - protein, 58 aa, ARTIFICIAL SEQUENCE
  Engineered IL-1R-I binding polypeptide
VDAKYAKEIEAVQYEIYYLPNLTRKQYTAFIRKLLDDPSQSSELLSEAKKLNDSQAPK

SEQ ID NO: 1494 - protein, 58 aa, ARTIFICIAL SEQUENCE
  Engineered IL-1R-I binding polypeptide
VDAKYAKELEHIQYEIFFLPNLTRKQYTAFIRKLFDDPSQSSELLSEAKKLNDSQAPK

SEQ ID NO: 1495 - protein, 58 aa, ARTIFICIAL SEQUENCE
  Engineered IL-1R-I binding polypeptide
VDAKYAKEVEEIQYEIFWLPNLTRKQYTAFIRKLLDDPSQSSELLSEAKKLNDSQAPK

SEQ ID NO: 1496 - protein, 58 aa, ARTIFICIAL SEQUENCE
  Engineered IL-1R-I binding polypeptide
VDAKYAKEVEEIQYEIFFLPNLTRKQYTAFIRKLLDDPSQSSELLSEAKKLNDSQAPK

SEQ ID NO: 1497 - protein, 58 aa, ARTIFICIAL SEQUENCE
  Engineered IL-1R-I binding polypeptide
VDAKYAKEVEEVQIEIYYLPNLTRKQYTAFIRKLLDDPSQSSELLSEAKKLNDSQAPK

SEQ ID NO: 1498 - protein, 58 aa, ARTIFICIAL SEQUENCE
  Engineered IL-1R-I binding polypeptide
VDAKYAKEVEDVQLEIYYLPNLTRKQYTAFIRKLLDDPSQSSELLSEAKKLNDSQAPK

SEQ ID NO: 1499 - protein, 58 aa, ARTIFICIAL SEQUENCE
  Engineered IL-1R-I binding polypeptide
VDAKYAKEIEEVQLEIFVLPNLTRRQYTAFIRKLFDDPSQSSELLSEAKKLNDSQAPK

SEQ ID NO: 1500 - protein, 58 aa, ARTIFICIAL SEQUENCE
  Engineered IL-1R-I binding polypeptide
VDAKYAKEIERIQMEIFYLPNLTRRQYTAFIRKLFDDPSQSSELLSEAKKLNDSQAPK

SEQ ID NO: 1501 - protein, 58 aa, ARTIFICIAL SEQUENCE
  Engineered IL-1R-I binding polypeptide
VDAKYAKELEQVQMEIFYLPNLTRKQYTAFIRKLLDDPSQSSELLSEAKKLNDSQAPK

SEQ ID NO: 1502 - protein, 58 aa, ARTIFICIAL SEQUENCE
  Engineered IL-1R-I binding polypeptide
VDAKYAKEVEEIQFEIFYLPNLTRRQYTAFIRKLLDDPSQSSELLSEAKKLNDSQAPK

SEQ ID NO: 1503 - protein, 58 aa, ARTIFICIAL SEQUENCE
  Engineered IL-1R-I binding polypeptide
VDAKYAKEIEEIQFEIFYLPNLTRRQYTAFIRKLLDDPSQSSELLSEAKKLNDSQAPK

SEQ ID NO: 1504 - protein, 58 aa, ARTIFICIAL SEQUENCE
  Engineered IL-1R-I binding polypeptide
VDAKYAKEIEEIQMEIFYLPNLTRKQYTAFIRKLLDDPSQSSELLSEAKKLNDSQAPK

SEQ ID NO: 1505 - protein, 58 aa, ARTIFICIAL SEQUENCE
  Engineered IL-1R-I binding polypeptide
VDAKYAKEIEEIQMEIYYLPNLTRRQYTAFIRKLLDDPSQSSELLSEAKKLNDSQAPK

SEQ ID NO: 1506 - protein, 58 aa, ARTIFICIAL SEQUENCE
  Engineered IL-1R-I binding polypeptide
VDAKYAKEVEEIQHEIYDLPNLTRKQYTAFIRKLLDDPSQSSELLSEAKKLNDSQAPK

SEQ ID NO: 1507 - protein, 58 aa, ARTIFICIAL SEQUENCE
  Engineered IL-1R-I binding polypeptide
VDAKYAKEIETIQLEIFDLPNLTRRQYTAFIRKLLDDPSQSSELLSEAKKLNDSQAPK

SEQ ID NO: 1508 - protein, 58 aa, ARTIFICIAL SEQUENCE
  Engineered IL-1R-I binding polypeptide
VDAKYAKEIETVQYEIYDLPNLTRKQYTAFIRKLLDDPSQSSELLSEAKKLNDSQAPK

SEQ ID NO: 1509 - protein, 58 aa, ARTIFICIAL SEQUENCE
  Engineered IL-1R-I binding polypeptide
VDAKYAKEIEEIQFEIYDLPNLTRKQYTAFIRKLFDDPSQSSELLSEAKKLNDSQAPK

SEQ ID NO: 1510 - protein, 58 aa, ARTIFICIAL SEQUENCE
  Engineered IL-1R-I binding polypeptide
VDAKYAKEVEEIQLEIYDLPNLTRKQYTAFIRKLLDDPSQSSELLSEAKKLNDSQAPK

SEQ ID NO: 1511 - protein, 58 aa, ARTIFICIAL SEQUENCE
  Engineered IL-1R-I binding polypeptide
VDAKYAKEVEEVQLEIFDLPNLTRKQYTAFIRKLLDDPSQSSELLSEAKKLNDSQAPK

SEQ ID NO: 1512 - protein, 58 aa, ARTIFICIAL SEQUENCE
  Engineered IL-1R-I binding polypeptide
VDAKYAKEIEEVQLEIFDLPNLTRRQYTAFIRKLLDDPSQSSELLSEAKKLNDSQAPK

SEQ ID NO: 1513 - protein, 58 aa, ARTIFICIAL SEQUENCE
  Engineered IL-1R-I binding polypeptide
VDAKYAKEIEEIQIEIFDLPNLTRKQYTAFIRKLLDDPSQSSELLSEAKKLNDSQAPK

SEQ ID NO: 1514 - protein, 58 aa, ARTIFICIAL SEQUENCE
  Engineered IL-1R-I binding polypeptide
VDAKYAKEVESVQFEIYHLPNLTRKQYTAFIRKLLDDPSQSSELLSEAKKLNDSQAPK

SEQ ID NO: 1515 - protein, 58 aa, ARTIFICIAL SEQUENCE
  Engineered IL-1R-I binding polypeptide
VDAKYAKEIESIQIEIFELPNLTRKQYTAFIRKLLDDPSQSSELLSEAKKLNDSQAPK

SEQ ID NO: 1516 - protein, 58 aa, ARTIFICIAL SEQUENCE
  Engineered IL-1R-I binding polypeptide
VDAKYAKEIESIQLEIFHLPNLTRKQYTAFIRKLFDDPSQSSELLSEAKKLNDSQAPK

SEQ ID NO: 1517 - protein, 58 aa, ARTIFICIAL SEQUENCE
  Engineered IL-1R-I binding polypeptide
VDAKYAKEVEDIQLEIFDLPNLTRRQYTAFIRKLLDDPSQSSELLSEAKKLNDSQAPK

SEQ ID NO: 1518 - protein, 58 aa, ARTIFICIAL SEQUENCE
  Engineered IL-1R-I binding polypeptide
VDAKYAKEVEDIQYEIFELPNLTRRQYTAFIRKLLDDPSQSSELLSEAKKLNDSQAPK

SEQ ID NO: 1519 - protein, 58 aa, ARTIFICIAL SEQUENCE
  Engineered IL-1R-I binding polypeptide
VDAKYAKEVEDIQLEIFELPNLTRRQYTAFIRKLLDDPSQSSELLSEAKKLNDSQAPK

SEQ ID NO: 1520 - protein, 58 aa, ARTIFICIAL SEQUENCE
  Engineered IL-1R-I binding polypeptide
VDAKYAKEIEDIQYEIFELPNLTRKQYTAFIRKLLDDPSQSSELLSEAKKLNDSQAPK

SEQ ID NO: 1521 - protein, 58 aa, ARTIFICIAL SEQUENCE
  Engineered IL-1R-I binding polypeptide
VDAKYAKEIEDIQLEIFELPNLTRKQYTAFIRKLLDDPSQSSELLSEAKKLNDSQAPK

SEQ ID NO: 1522 - protein, 58 aa, ARTIFICIAL SEQUENCE
  Engineered IL-1R-I binding polypeptide
VDAKYAKEIEDIQLEIYHLPNLTRKQYTAFIRKLLDDPSQSSELLSEAKKLNDSQAPK

SEQ ID NO: 1523 - protein, 58 aa, ARTIFICIAL SEQUENCE
  Engineered IL-1R-I binding polypeptide
VDAKYAKEIEDIQIEIFHLPNLTRKQYTAFIRKLLDDPSQSSELLSEAKKLNDSQAPK

SEQ ID NO: 1524 - protein, 58 aa, ARTIFICIAL SEQUENCE
  Engineered IL-1R-I binding polypeptide
VDAKYAKEIEDVQIEIFQLPNLTRKQYTAFIRKLLDDPSQSSELLSEAKKLNDSQAPK

SEQ ID NO: 1525 - protein, 58 aa, ARTIFICIAL SEQUENCE
  Engineered IL-1R-I binding polypeptide
VDAKYAKEIEDIQLEIFKLPNLTRKQYTAFIRKLLDDPSQSSELLSEAKKLNDSQAPK

SEQ ID NO: 1526 - protein, 58 aa, ARTIFICIAL SEQUENCE
  Engineered IL-1R-I binding polypeptide
VDAKYAKEIEDVQLEIFKLPNLTRRQYTAFIRKLLDDPSQSSELLSEAKKLNDSQAPK

SEQ ID NO: 1527 - protein, 58 aa, ARTIFICIAL SEQUENCE
  Engineered IL-1R-I binding polypeptide
VDAKYAKEVEKIQFEIFKLPNLTRKQYTAFIRKLLDDPSQSSELLSEAKKLNDSQAPK

SEQ ID NO: 1528 - protein, 58 aa, ARTIFICIAL SEQUENCE
  Engineered IL-1R-I binding polypeptide
VDAKYAKEIEWVQLEIFHLPNLTRKQYTAFIRKLLDDPSQSSELLSEAKKLNDSQAPK

SEQ ID NO: 1529 - protein, 58 aa, ARTIFICIAL SEQUENCE
  Engineered IL-1R-I binding polypeptide
VDAKYAKELERIQLEIFHLPNLTRKQYTAFIRKLLDDPSQSSELLSEAKKLNDSQAPK

SEQ ID NO: 1530 - protein, 58 aa, ARTIFICIAL SEQUENCE
  Engineered IL-1R-I binding polypeptide
VDAKYAKELEKIQLEIYHLPNLTRKQYTAFIRKLLDDPSQSSELLSEAKKLNDSQAPK

SEQ ID NO: 1531 - protein, 58 aa, ARTIFICIAL SEQUENCE
  Engineered IL-1R-I binding polypeptide
VDAKYAKEIEKVQIEIFQLPNLTRKQYTAFIRKLLDDPSQSSELLSEAKKLNDSQAPK

SEQ ID NO: 1532 - protein, 58 aa, ARTIFICIAL SEQUENCE
  Engineered IL-1R-I binding polypeptide
VDAKYAKEIEEIQLEIYHLPNLTRKQYTAFIRKLFDDPSQSSELLSEAKKLNDSQAPK

SEQ ID NO: 1533 - protein, 58 aa, ARTIFICIAL SEQUENCE
  Engineered IL-1R-I binding polypeptide
VDAKYAKEIEEIQLEIFRLPNLTRKQYTAFIRKLLDDPSQSSELLSEAKKLNDSQAPK

SEQ ID NO: 1534 - protein, 58 aa, ARTIFICIAL SEQUENCE
  Engineered IL-1R-I binding polypeptide
VDAKYAKEIEEIQFEIFHLPNLTRKQYTAFIRKLLDDPSQSSELLSEAKKLNDSQAPK

SEQ ID NO: 1535 - protein, 58 aa, ARTIFICIAL SEQUENCE
  Engineered IL-1R-I binding polypeptide
VDAKYAKEIEEIQYEIFHLPNLTRKQYTAFIRKLLDDPSQSSELLSEAKKLNDSQAPK

SEQ ID NO: 1536 - protein, 58 aa, ARTIFICIAL SEQUENCE
  Engineered IL-1R-I binding polypeptide
VDAKYAKEIEEIQLEIFHLPNLTRKQYTAFIRKLLDDPSQSSELLSEAKKLNDSQAPK

SEQ ID NO: 1537 - protein, 58 aa, ARTIFICIAL SEQUENCE
  Engineered IL-1R-I binding polypeptide
VDAKYAKELEEIQLEIYKLPNLTRRQYTAFIRKLLDDPSQSSELLSEAKKLNDSQAPK

SEQ ID NO: 1538 - protein, 58 aa, ARTIFICIAL SEQUENCE
  Engineered IL-1R-I binding polypeptide
VDAKYAKELEEIQLEIYHLPNLTRRQYTAFIRKLLDDPSQSSELLSEAKKLNDSQAPK

SEQ ID NO: 1539 - protein, 58 aa, ARTIFICIAL SEQUENCE
  Engineered IL-1R-I binding polypeptide
VDAKYAKEIEQVQLEIFHLPNLTRRQYTAFIRKLLDDPSQSSELLSEAKKLNDSQAPK

SEQ ID NO: 1540 - protein, 58 aa, ARTIFICIAL SEQUENCE
  Engineered IL-1R-I binding polypeptide
VDAKYAKEIEEVQMEIFHLPNLTRRQYTAFIRKLLDDPSQSSELLSEAKKLNDSQAPK

SEQ ID NO: 1541 - protein, 58 aa, ARTIFICIAL SEQUENCE
  Engineered IL-1R-I binding polypeptide
VDAKYAKEVEEIQIEIFKLPNLTRKQYTAFIRKLFDDPSQSSELLSEAKKLNDSQAPK

SEQ ID NO: 1542 - protein, 58 aa, ARTIFICIAL SEQUENCE
  Engineered IL-1R-I binding polypeptide
VDAKYAKEVEEVQLEIFKLPNLTRKQYTAFIRKLLDDPSQSSELLSEAKKLNDSQAPK

SEQ ID NO: 1543 - protein, 58 aa, ARTIFICIAL SEQUENCE
  Engineered IL-1R-I binding polypeptide
VDAKYAKEVEEIQVEIFQLPNLTRKQYTAFIRKLFDDPSQSSELLSEAKKLNDSQAPK

SEQ ID NO: 1544 - protein, 58 aa, ARTIFICIAL SEQUENCE
  Engineered IL-1R-I binding polypeptide
VDAKYAKEVEEVQLEIFHLPNLTRKQYTAFIRKLFDDPSQSSELLSEAKKLNDSQAPK

SEQ ID NO: 1545 - protein, 58 aa, ARTIFICIAL SEQUENCE
  Engineered IL-1R-I binding polypeptide
VDAKYAKEVEEIQLEIFHLPNLTRKQYTAFIRKLFDDPSQSSELLSEAKKLNDSQAPK

SEQ ID NO: 1546 - protein, 58 aa, ARTIFICIAL SEQUENCE
  Engineered IL-1R-I binding polypeptide
VDAKYAKEVEEVQIEIFQLPNLTRRQYTAFIRKLLDDPSQSSELLSEAKKLNDSQAPK

SEQ ID NO: 1547 - protein, 58 aa, ARTIFICIAL SEQUENCE
  Engineered IL-1R-I binding polypeptide
VDAKYAKEVEEVQIEIFELPNLTRKQYTAFIRKLLDDPSQSSELLSEAKKLNDSQAPK

SEQ ID NO: 1548 - protein, 58 aa, ARTIFICIAL SEQUENCE
  Engineered IL-1R-I binding polypeptide
VDAKYAKEVEEIQLEIFRLPNLTRRQYTAFIRKLLDDPSQSSELLSEAKKLNDSQAPK

SEQ ID NO: 1549 - protein, 58 aa, ARTIFICIAL SEQUENCE
  Engineered IL-1R-I binding polypeptide
VDAKYAKEVEEVQLEIYSLPNLTRRQYTAFIRKLLDDPSQSSELLSEAKKLNDSQAPK

SEQ ID NO: 1550 - protein, 58 aa, ARTIFICIAL SEQUENCE
  Engineered IL-1R-I binding polypeptide
VDAKYAKEIEQIQLEIFSLPNLTRRQYTAFIRKLFDDPSQSSELLSEAKKLNDSQAPK

SEQ ID NO: 1551 - protein, 58 aa, ARTIFICIAL SEQUENCE
  Engineered IL-1R-I binding polypeptide
VDAKYAKELEDVQLEIFSLPNLTRRQYTAFIRKLLDDPSQSSELLSEAKKLNDSQAPK

SEQ ID NO: 1552 - protein, 58 aa, ARTIFICIAL SEQUENCE
  Engineered IL-1R-I binding polypeptide
VDAKYAKEIEQIQMEIFSLPNLTRKQYTAFIRKLLDDPSQSSELLSEAKKLNDSQAPK

SEQ ID NO: 1553 - protein, 58 aa, ARTIFICIAL SEQUENCE
  Engineered IL-1R-I binding polypeptide
VDAKYAKEIEEVQLEIFSLPNLTRKQYTAFIRKLLDDPSQSSELLSEAKKLNDSQAPK

SEQ ID NO: 1554 - protein, 58 aa, ARTIFICIAL SEQUENCE
  Engineered IL-1R-I binding polypeptide
VDAKYAKEIEEIQLEIFSLPNLTRKQYTAFIRKLLDDPSQSSELLSEAKKLNDSQAPK

SEQ ID NO: 1555 - protein, 58 aa, ARTIFICIAL SEQUENCE
  Engineered IL-1R-I binding polypeptide
VDAKYAKEIEDIQVEIYGLPNLTRRQYTAFIRKLLDDPSQSSELLSEAKKLNDSQAPK

SEQ ID NO: 1556 - protein, 58 aa, ARTIFICIAL SEQUENCE
  Engineered IL-1R-I binding polypeptide
VDAKYAKELETVQLEIFGLPNLTRRQYTAFIRKLLDDPSQSSELLSEAKKLNDSQAPK

SEQ ID NO: 1557 - protein, 58 aa, ARTIFICIAL SEQUENCE
  Engineered IL-1R-I binding polypeptide
VDAKYAKEIETIQLEIFGLPNLTRKQYTAFIRKLLDDPSQSSELLSEAKKLNDSQAPK

SEQ ID NO: 1558 - protein, 58 aa, ARTIFICIAL SEQUENCE
  Engineered IL-1R-I binding polypeptide
VDAKYAKEIEQVQLEIFGLPNLTRKQYTAFIRKLLDDPSQSSELLSEAKKLNDSQAPK

SEQ ID NO: 1559 - protein, 58 aa, ARTIFICIAL SEQUENCE
  Engineered IL-1R-I binding polypeptide
VDAKYAKEIESVQLEIFGLPNLTRRQYTAFIRKLLDDPSQSSELLSEAKKLNDSQAPK

SEQ ID NO: 1560 - protein, 58 aa, ARTIFICIAL SEQUENCE
  Engineered IL-1R-I binding polypeptide
VDAKYAKEIEEVQLEIFGLPNLTRKQYTAFIRKLLDDPSQSSELLSEAKKLNDSQAPK

SEQ ID NO: 1561 - protein, 58 aa, ARTIFICIAL SEQUENCE
  Engineered IL-1R-I binding polypeptide
VDAKYAKEVEEIQLEIFGLPNLTRKQYTAFIRKLLDDPSQSSELLSEAKKLNDSQAPK

SEQ ID NO: 1562 - protein, 58 aa, ARTIFICIAL SEQUENCE
  Engineered IL-1R-I binding polypeptide
VDAKYAKEVEEVQFEIFGLPNLTRKQYTAFIRKLLDDPSQSSELLSEAKKLNDSQAPK

SEQ ID NO: 1563 - protein, 58 aa, ARTIFICIAL SEQUENCE
  Engineered IL-1R-I binding polypeptide
VDAKYAKEVEEIQFEIFGLPNLTRKQYTAFIRKLLDDPSQSSELLSEAKKLNDSQAPK

SEQ ID NO: 1564 - protein, 58 aa, ARTIFICIAL SEQUENCE
  Engineered IL-1R-I binding polypeptide
VDAKYAKEVEEIQYEIFGLPNLTRKQYTAFIRKLLDDPSQSSELLSEAKKLNDSQAPK

SEQ ID NO: 1565 - protein, 58 aa, ARTIFICIAL SEQUENCE
  Engineered IL-1R-I binding polypeptide
VDAKYAKEVEEIQLEIFGLPNLTRRQYTAFIRKLLDDPSQSSELLSEAKKLNDSQAPK

SEQ ID NO: 1566 - protein, 58 aa, ARTIFICIAL SEQUENCE
  Engineered IL-1R-I binding polypeptide
VDAKYAKETEEVQYEIFALPNLTRKQYTAFIRKLLDDPSQSSELLSEAKKLNDSQAPK

SEQ ID NO: 1567 - protein, 58 aa, ARTIFICIAL SEQUENCE
  Engineered IL-1R-I binding polypeptide
VDAKYAKETEHIQYEIFALPNLTRKQYTAFIRKLLDDPSQSSELLSEAKKLNDSQAPK

SEQ ID NO: 1568 - protein, 58 aa, ARTIFICIAL SEQUENCE
  Engineered IL-1R-I binding polypeptide
VDAKYAKETEQVQYEIFALPNLTRKQYTAFIRKLLDDPSQSSELLSEAKKLNDSQAPK

SEQ ID NO: 1569 - protein, 58 aa, ARTIFICIAL SEQUENCE
  Engineered IL-1R-I binding polypeptide
VDAKYAKETEKIQFEIFALPNLTRKQYTAFIRKLLDDPSQSSELLSEAKKLNDSQAPK

SEQ ID NO: 1570 - protein, 58 aa, ARTIFICIAL SEQUENCE
  Engineered IL-1R-I binding polypeptide
VDAKYAKETEEIQLEIYALPNLTRRQYTAFIRKLLDDPSQSSELLSEAKKLNDSQAPK

SEQ ID NO: 1571 - protein, 58 aa, ARTIFICIAL SEQUENCE
  Engineered IL-1R-I binding polypeptide
VDAKYAKETEEIQMEIFALPNLTRRQYTAFIRKLLDDPSQSSELLSEAKKLNDSQAPK

SEQ ID NO: 1572 - protein, 58 aa, ARTIFICIAL SEQUENCE
  Engineered IL-1R-I binding polypeptide
VDAKYAKEIESIQYEIFALPNLTRKQYTAFIRKLFDDPSQSSELLSEAKKLNDSQAPK

SEQ ID NO: 1573 - protein, 58 aa, ARTIFICIAL SEQUENCE
  Engineered IL-1R-I binding polypeptide
VDAKYAKEIESVQLEIFALPNLTRKQYTAFIRKLFDDPSQSSELLSEAKKLNDSQAPK

SEQ ID NO: 1574 - protein, 58 aa, ARTIFICIAL SEQUENCE
  Engineered IL-1R-I binding polypeptide
VDAKYAKEIESIQLEIFALPNLTRKQYTAFIRKLFDDPSQSSELLSEAKKLNDSQAPK

SEQ ID NO: 1575 - protein, 58 aa, ARTIFICIAL SEQUENCE
  Engineered IL-1R-I binding polypeptide
VDAKYAKELESVQLEIFALPNLTRKQYTAFIRKLLDDPSQSSELLSEAKKLNDSQAPK

SEQ ID NO: 1576 - protein, 58 aa, ARTIFICIAL SEQUENCE
  Engineered IL-1R-I binding polypeptide
VDAKYAKEIETIQYEIFALPNLTRKQYTAFIRKLLDDPSQSSELLSEAKKLNDSQAPK

SEQ ID NO: 1577 - protein, 58 aa, ARTIFICIAL SEQUENCE
  Engineered IL-1R-I binding polypeptide
VDAKYAKEVETVQYEIFALPNLTRKQYTAFIRKLLDDPSQSSELLSEAKKLNDSQAPK

SEQ ID NO: 1578 - protein, 58 aa, ARTIFICIAL SEQUENCE
  Engineered IL-1R-I binding polypeptide
VDAKYAKEIEQIQYEIFALPNLTRKQYTAFIRKLLDDPSQSSELLSEAKKLNDSQAPK

SEQ ID NO: 1579 - protein, 58 aa, ARTIFICIAL SEQUENCE
  Engineered IL-1R-I binding polypeptide
VDAKYAKEIEHVQYEIFALPNLTRKQYTAFIRKLLDDPSQSSELLSEAKKLNDSQAPK

SEQ ID NO: 1580 - protein, 58 aa, ARTIFICIAL SEQUENCE
  Engineered IL-1R-I binding polypeptide
VDAKYAKEIEHIQLEIFALPNLTRKQYTAFIRKLFDDPSQSSELLSEAKKLNDSQAPK

SEQ ID NO: 1581 - protein, 58 aa, ARTIFICIAL SEQUENCE
  Engineered IL-1R-I binding polypeptide
VDAKYAKEVEKVQLEIFALPNLTRKQYTAFIRKLFDDPSQSSELLSEAKKLNDSQAPK

SEQ ID NO: 1582 - protein, 58 aa, ARTIFICIAL SEQUENCE
  Engineered IL-1R-I binding polypeptide
VDAKYAKEIEEVQLEIYALPNLTRRQYTAFIRKLLDDPSQSSELLSEAKKLNDSQAPK

SEQ ID NO: 1583 - protein, 58 aa, ARTIFICIAL SEQUENCE
  Engineered IL-1R-I binding polypeptide
VDAKYAKEVEQVQFEIFALPNLTRKQYTAFIRKLLDDPSQSSELLSEAKKLNDSQAPK

SEQ ID NO: 1584 - protein, 58 aa, ARTIFICIAL SEQUENCE
  Engineered IL-1R-I binding polypeptide
VDAKYAKEVEQIQLEIFALPNLTRKQYTAFIRKLLDDPSQSSELLSEAKKLNDSQAPK

SEQ ID NO: 1585 - protein, 58 aa, ARTIFICIAL SEQUENCE
  Engineered IL-1R-I binding polypeptide
VDAKYAKEVEEVQYEIFALPNLTRKQYTAFIRKLLDDPSQSSELLSEAKKLNDSQAPK

SEQ ID NO: 1586 - protein, 58 aa, ARTIFICIAL SEQUENCE
  Engineered IL-1R-I binding polypeptide
VDAKYAKEVEEIQLEIYALPNLTRKQYTAFIRKLLDDPSQSSELLSEAKKLNDSQAPK

SEQ ID NO: 1587 - protein, 58 aa, ARTIFICIAL SEQUENCE
  Engineered IL-1R-I binding polypeptide
VDAKYAKEVEEIQLEIFALPNLTRKQYTAFIRKLLDDPSQSSELLSEAKKLNDSQAPK

SEQ ID NO: 1588 - protein, 58 aa, ARTIFICIAL SEQUENCE
  Engineered IL-1R-I binding polypeptide
VDAKYAKEVEEVQLEIFALPNLTRKQYTAFIRKLLDDPSQSSELLSEAKKLNDSQAPK

SEQ ID NO: 1589 - protein, 58 aa, ARTIFICIAL SEQUENCE
  Engineered IL-1R-I binding polypeptide
VDAKYAKEVEEIQLEIFALPNLTRRQYTAFIRKLLDDPSQSSELLSEAKKLNDSQAPK

SEQ ID NO: 1590 - protein, 58 aa, ARTIFICIAL SEQUENCE
  Engineered IL-1R-I binding polypeptide
VDAKYAKEIEEIQFEIFALPNLTRKQYTAFIRKLLDDPSQSSELLSEAKKLNDSQAPK

SEQ ID NO: 1591 - protein, 58 aa, ARTIFICIAL SEQUENCE
  Engineered IL-1R-I binding polypeptide
VDAKYAKEIEEIQLEIFALPNLTRKQYTAFIRKLLDDPSQSSELLSEAKKLNDSQAPK

SEQ ID NO: 1592 - protein, 58 aa, ARTIFICIAL SEQUENCE
  Engineered IL-1R-I binding polypeptide
VDAKYAKEIEDVQLEIFALPNLTRKQYTAFIRKLLDDPSQSSELLSEAKKLNDSQAPK

SEQ ID NO: 1593 - protein, 58 aa, ARTIFICIAL SEQUENCE
  Engineered IL-1R-I binding polypeptide
VDAKYAKEIEDIQLEIFGLPNLTRKQYTAFIRKLLDDPSQSSELLSEAKKLNDSQAPK

SEQ ID NO: 1594 - protein, 58 aa, ARTIFICIAL SEQUENCE
  Engineered IL-1R-I binding polypeptide
VDAKYAKEVEDIQLEIFALPNLTRRQYTAFIRKLLDDPSQSSELLSEAKKLNDSQAPK

SEQ ID NO: 1595 - protein, 58 aa, ARTIFICIAL SEQUENCE
  Engineered IL-1R-I binding polypeptide
VDAKYAKETEVVQYEIFALPNLTRKQYTAFIRKLLDDPSQSSELLSEAKKLNDSQAPK

SEQ ID NO: 1596 - protein, 58 aa, ARTIFICIAL SEQUENCE
  Engineered IL-1R-I binding polypeptide
VDAKYAKEAEIVQYEIFALPNLTRKQYTAFIRKLLDDPSQSSELLSEAKKLNDSQAPK

SEQ ID NO: 1597 - protein, 58 aa, ARTIFICIAL SEQUENCE
  Engineered IL-1R-I binding polypeptide
VDAKYAKEVEFVQYEIFQLPNLTRRQYTAFIRKLLDDPSQSSELLSEAKKLNDSQAPK

SEQ ID NO: 1598 - protein, 58 aa, ARTIFICIAL SEQUENCE
  Engineered IL-1R-I binding polypeptide
VDAKYAKEIEIVQFEIFHLPNLTRKQYTAFIRKLLDDPSQSSELLSEAKKLNDSQAPK

SEQ ID NO: 1599 - protein, 58 aa, ARTIFICIAL SEQUENCE
  Engineered IL-1R-I binding polypeptide
VDAKYAKEVEIIQLEIFHLPNLTRRQYTAFIRKLLDDPSQSSELLSEAKKLNDSQAPK

SEQ ID NO: 1600 - protein, 58 aa, ARTIFICIAL SEQUENCE
  Engineered IL-1R-I binding polypeptide
VDAKYAKEVETIQLEIFALPNLTRRQYTAFIRKLLDDPSQSSELLSEAKKLNDSQAPK

SEQ ID NO: 1601 - protein, 58 aa, ARTIFICIAL SEQUENCE
  Engineered IL-1R-I binding polypeptide
VDAKYAKEVEYIQLEIFALPNLTRRQYTAFIRKLLDDPSQSSELLSEAKKLNDSQAPK

SEQ ID NO: 1602 - protein, 58 aa, ARTIFICIAL SEQUENCE
  Engineered IL-1R-I binding polypeptide
VDAKYAKEIELIQLEIYALPNLTRKQYTAFIRKLFDDPSQSSELLSEAKKLNDSQAPK

SEQ ID NO: 1603 - protein, 58 aa, ARTIFICIAL SEQUENCE
  Engineered IL-1R-I binding polypeptide
VDAKYAKEIEYVQFEIFALPNLTRKQYTAFIRKLLDDPSQSSELLSEAKKLNDSQAPK

SEQ ID NO: 1604 - protein, 58 aa, ARTIFICIAL SEQUENCE
  Engineered IL-1R-I binding polypeptide
VDAKYAKEIEVIQYEIFALPNLTRRQYTAFIRKLLDDPSQSSELLSEAKKLNDSQAPK

SEQ ID NO: 1605 - protein, 58 aa, ARTIFICIAL SEQUENCE
  Engineered IL-1R-I binding polypeptide
VDAKYAKEIEVIQLEIFALPNLTRRQYTAFIRKLLDDPSQSSELLSEAKKLNDSQAPK

SEQ ID NO: 1606 - protein, 58 aa, ARTIFICIAL SEQUENCE
  Engineered IL-1R-I binding polypeptide
VDAKYAKEIEVIQLEIFALPNLTRKQYTAFIRKLFDDPSQSSELLSEAKKLNDSQAPK

SEQ ID NO: 1607 - protein, 58 aa, ARTIFICIAL SEQUENCE
  Engineered IL-1R-I binding polypeptide
VDAKYAKEVEYIQMEIFALPNLTRKQYTAFIRKLFDDPSQSSELLSEAKKLNDSQAPK

SEQ ID NO: 1608 - protein, 58 aa, ARTIFICIAL SEQUENCE
  Engineered IL-1R-I binding polypeptide
VDAKYAKEVEIVQFEIFALPNLTRKQYTAFIRKLLDDPSQSSELLSEAKKLNDSQAPK

SEQ ID NO: 1609 - protein, 58 aa, ARTIFICIAL SEQUENCE
  Engineered IL-1R-I binding polypeptide
VDAKYAKEVEVIQLEIYALPNLTRKQYTAFIRKLLDDPSQSSELLSEAKKLNDSQAPK

SEQ ID NO: 1610 - protein, 58 aa, ARTIFICIAL SEQUENCE
  Engineered IL-1R-I binding polypeptide
VDAKYAKEVEVIQYEIFALPNLTRKQYTAFIRKLLDDPSQSSELLSEAKKLNDSQAPK

SEQ ID NO: 1611 - protein, 58 aa, ARTIFICIAL SEQUENCE
  Engineered IL-1R-I binding polypeptide
VDAKYAKEVEVIQLEIFSLPNLTRRQYTAFIRKLLDDPSQSSELLSEAKKLNDSQAPK

SEQ ID NO: 1612 - protein, 58 aa, ARTIFICIAL SEQUENCE
  Engineered IL-1R-I binding polypeptide
VDAKYAKELEIIQLEIFSLPNLTRKQYTAFIRKLLDDPSQSSELLSEAKKLNDSQAPK

SEQ ID NO: 1613 - protein, 58 aa, ARTIFICIAL SEQUENCE
  Engineered IL-1R-I binding polypeptide
VDAKYAKEIEVVQLEIFGLPNLTRKQYTAFIRKLLDDPSQSSELLSEAKKLNDSQAPK

SEQ ID NO: 1614 - protein, 58 aa, ARTIFICIAL SEQUENCE
  Engineered IL-1R-I binding polypeptide
VDAKYAKEIEVVQLEIFGLPNLTRRQYTAFIRKLLDDPSQSSELLSEAKKLNDSQAPK

SEQ ID NO: 1615 - protein, 58 aa, ARTIFICIAL SEQUENCE
  Engineered IL-1R-I binding polypeptide
VDAKYAKEIEIIQMEIFGLPNLTRKQYTAFIRKLLDDPSQSSELLSEAKKLNDSQAPK

SEQ ID NO: 1616 - protein, 58 aa, ARTIFICIAL SEQUENCE
  Engineered IL-1R-I binding polypeptide
VDAKYAKEVEVVQFEIYGLPNLTRKQYTAFIRKLLDDPSQSSELLSEAKKLNDSQAPK

SEQ ID NO: 1617 - protein, 58 aa, ARTIFICIAL SEQUENCE
  Engineered IL-1R-I binding polypeptide
VDAKYAKEVEYVQLEIYGLPNLTRKQYTAFIRKLLDDPSQSSELLSEAKKLNDSQAPK

SEQ ID NO: 1618 - protein, 58 aa, ARTIFICIAL SEQUENCE
  Engineered IL-1R-I binding polypeptide
VDAKYAKEVEIIQYEIFGLPNLTRKQYTAFIRKLLDDPSQSSELLSEAKKLNDSQAPK

SEQ ID NO: 1619 - protein, 58 aa, ARTIFICIAL SEQUENCE
  Engineered IL-1R-I binding polypeptide
VDAKYAKELEAIQMEIFVLPNLTRRQYTAFIRKLLDDPSQSSELLSEAKKLNDSQAPK

SEQ ID NO: 1620 - protein, 58 aa, ARTIFICIAL SEQUENCE
  Engineered IL-1R-I binding polypeptide
VDAKYAKEVEAIQMEIFFLPNLTRRQYTAFIRKLLDDPSQSSELLSEAKKLNDSQAPK

SEQ ID NO: 1621 - protein, 58 aa, ARTIFICIAL SEQUENCE
  Engineered IL-1R-I binding polypeptide
VDAKYAKELEAIQLEIYELPNLTRKQYTAFIRKLLDDPSQSSELLSEAKKLNDSQAPK

SEQ ID NO: 1622 - protein, 58 aa, ARTIFICIAL SEQUENCE
  Engineered IL-1R-I binding polypeptide
VDAKYAKEVEAIQFEIFQLPNLTRKQYTAFIRKLLDDPSQSSELLSEAKKLNDSQAPK

SEQ ID NO: 1623 - protein, 58 aa, ARTIFICIAL SEQUENCE
  Engineered IL-1R-I binding polypeptide
VDAKYAKEVEAIQFEIYHLPNLTRKQYTAFIRKLLDDPSQSSELLSEAKKLNDSQAPK

SEQ ID NO: 1624 - protein, 58 aa, ARTIFICIAL SEQUENCE
  Engineered IL-1R-I binding polypeptide
VDAKYAKEVEAIQLEIYHLPNLTRKQYTAFIRKLFDDPSQSSELLSEAKKLNDSQAPK

SEQ ID NO: 1625 - protein, 58 aa, ARTIFICIAL SEQUENCE
  Engineered IL-1R-I binding polypeptide
VDAKYAKEIEAVQIEIFRLPNLTRKQYTAFIRKLLDDPSQSSELLSEAKKLNDSQAPK

SEQ ID NO: 1626 - protein, 58 aa, ARTIFICIAL SEQUENCE
  Engineered IL-1R-I binding polypeptide
VDAKYAKEIEAIQLEIFHLPNLTRKQYTAFIRKLFDDPSQSSELLSEAKKLNDSQAPK

SEQ ID NO: 1627 - protein, 58 aa, ARTIFICIAL SEQUENCE
  Engineered IL-1R-I binding polypeptide
VDAKYAKEIEAIQMEIFHLPNLTRKQYTAFIRKLFDDPSQSSELLSEAKKLNDSQAPK

SEQ ID NO: 1628 - protein, 58 aa, ARTIFICIAL SEQUENCE
  Engineered IL-1R-I binding polypeptide
VDAKYAKEVEAIQMEIFQLPNLTRRQYTAFIRKLLDDPSQSSELLSEAKKLNDSQAPK

SEQ ID NO: 1629 - protein, 58 aa, ARTIFICIAL SEQUENCE
  Engineered IL-1R-I binding polypeptide
VDAKYAKEIEAIQYEIFALPNLTRKQYTAFIRKLLDDPSQSSELLSEAKKLNDSQAPK

SEQ ID NO: 1630 - protein, 58 aa, ARTIFICIAL SEQUENCE
  Engineered IL-1R-I binding polypeptide
VDAKYAKEIEAIQLEIYALPNLTRKQYTAFIRKLLDDPSQSSELLSEAKKLNDSQAPK

SEQ ID NO: 1631 - protein, 58 aa, ARTIFICIAL SEQUENCE
  Engineered IL-1R-I binding polypeptide
VDAKYAKEIEAIQLEIFALPNLTRKQYTAFIRKLLDDPSQSSELLSEAKKLNDSQAPK

SEQ ID NO: 1632 - protein, 58 aa, ARTIFICIAL SEQUENCE
  Engineered IL-1R-I binding polypeptide
VDAKYAKEVEAVQLEIFALPNLTRRQYTAFIRKLLDDPSQSSELLSEAKKLNDSQAPK

SEQ ID NO: 1633 - protein, 58 aa, ARTIFICIAL SEQUENCE
  Engineered IL-1R-I binding polypeptide
AEAKYAKEAEEAYYEIFGLPNLTRRQYTAFIRKLLDDPSQSSELLSEAKKLNDSQAPK

SEQ ID NO: 1634 - protein, 58 aa, ARTIFICIAL SEQUENCE
  Engineered IL-1R-I binding polypeptide
AEAKYAKEADAAYMEIFGLPNLTRKQYTAFIRKLLDDPSQSSELLSEAKKLNDSQAPK

SEQ ID NO: 1635 - protein, 58 aa, ARTIFICIAL SEQUENCE
  Engineered IL-1R-I binding polypeptide
AEAKYAKEIEAVQMEIFYLPNLTRKQYTAFIRKLFDDPSQSSELLSEAKKLNDSQAPK

SEQ ID NO: 1636 - protein, 58 aa, ARTIFICIAL SEQUENCE
  Engineered IL-1R-I binding polypeptide
AEAKYAKEIEAAQMEIFGLPNLTRKQYTAFIRKLFDDPSQSSELLSEAKKLNDSQAPK

SEQ ID NO: 1637 - protein, 58 aa, ARTIFICIAL SEQUENCE
  Engineered IL-1R-I binding polypeptide
AEAKYAKELEAAYMEIYYLPNLTRKQYTAFIRKLLDDPSQSSELLSEAKKLNDSQAPK

SEQ ID NO: 1638 - protein, 58 aa, ARTIFICIAL SEQUENCE
  Engineered IL-1R-I binding polypeptide
AEAKYAKEAEKAYYEIFNLPNLTRKQYTAFIRKLLDDPSQSSELLSEAKKLNDSQAPK

SEQ ID NO: 1639 - protein, 108 aa, ARTIFICIAL SEQUENCE
  Engineered IL-1R-I binding polypeptide
AEAKYAKEAHRAQMEIFALPNLTRRQYTAFIRKLLDDPSQSSELLSEAKKLSESQAPKVEGSLAEAKEAANAELDSYGVSDFYKRLIDKAKTVEGVEALKDAILAALP

SEQ ID NO: 1640 - protein, 108 aa, ARTIFICIAL SEQUENCE
  Engineered IL-1R-I binding polypeptide
AEAKYAKEALSAQQEIFALPNLTRRQYTAFIRKLLDDPSQSSELLSEAKKLSESQAPKVEGSLAEAKEAANAELDSYGVSDFYKRLIDKAKTVEGVEALKDAILAALP

SEQ ID NO: 1641 - protein, 108 aa, ARTIFICIAL SEQUENCE
  Engineered IL-1R-I binding polypeptide
ASLAEAKEAANAELDSYGVSDFYKRLIDKAKTVEGVEALKDAILAALPGSAEAKYAKEAHRAQMEIFALPNLTRRQYTAFIRKLLDDPSQSSELLSEAKKLSESQAPK

SEQ ID NO: 1642 - protein, 116 aa, ARTIFICIAL SEQUENCE
  Engineered IL-1R-I binding polypeptide
ASLAEAKEAANAELDSYGVSDFYKRLIDKAKTVEGVEALKDAILAALPGGGGSGGGGSAEAKYAKEAHRAQMEIFALPNLTRRQYTAFIRKLLDDPSQSSELLSEAKKLSESQAPK

SEQ ID NO: 1643 - protein, 106 aa, ARTIFICIAL SEQUENCE
  Engineered IL-1R-I binding polypeptide
ASLAEAKEAANAELDSYGVSDFYKRLIDKAKTVEGVEALKDAILAALPAEAKYAKEAHRAQMEIFALPNLTRRQYTAFIRKLLDDPSQSSELLSEAKKLSESQAPK

SEQ ID NO: 1644 - protein, 103 aa, ARTIFICIAL SEQUENCE
  Engineered IL-1R-I binding polypeptide
ASLAEAKEAANAELDSYGVSDFYKRLIDKAKTVEGVEALKDAILAALPKYAKEAHRAQMEIFALPNLTRRQYTAFIRKLLDDPSQSSELLSEAKKLSESQAPK

SEQ ID NO: 1645 - protein, 146 aa, ARTIFICIAL SEQUENCE
  Engineered IL-1R-I binding polypeptide
ASLAEAKEAANAELDSYGVSDFYKRLIDKAKTVEGVEALKDAILAALPKEAAAKEAAAKEAAAKELAAKEAAAKEAAAKEAAAKELAAAEAKYAKEAHRAQMEIFALPNLTRRQYTAFIRKLLDDPSQSSELLSEAKKLSESQAPK

SEQ ID NO: 1646 - protein, 297 aa, ARTIFICIAL SEQUENCE
  Engineered IL-1R-I binding polypeptide
AEAKYAKEIEEVQMEIFYLPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1647 - protein, 297 aa, ARTIFICIAL SEQUENCE
  Engineered IL-1R-I binding polypeptide
AEAKYAKEIEEIQMEIFHLPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1648 - protein, 297 aa, ARTIFICIAL SEQUENCE
  Engineered IL-1R-I binding polypeptide
AEAKYAKEVEEIQMEIFRLPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1649 - protein, 297 aa, ARTIFICIAL SEQUENCE
  Engineered IL-1R-I binding polypeptide
AEAKYAKEVEDIQLEIFALPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1650 - protein, 297 aa, ARTIFICIAL SEQUENCE
  Engineered IL-1R-I binding polypeptide
AEAKYAKELEAIQMEIFHLPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1651 - protein, 297 aa, ARTIFICIAL SEQUENCE
  Engineered IL-1R-I binding polypeptide
AEAKYAKETEAVQMEIFALPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1652 - protein, 297 aa, ARTIFICIAL SEQUENCE
  Engineered IL-1R-I binding polypeptide
AEAKYAKEIEEIQMEIFRLPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1653 - protein, 297 aa, ARTIFICIAL SEQUENCE
  Engineered IL-1R-I binding polypeptide
AEAKYAKELEAIQMEIFYLPNLTRRQYVAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1654 - protein, 297 aa, ARTIFICIAL SEQUENCE
  Engineered IL-1R-I binding polypeptide
AEAKYAKELEEIQMEIFYLPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1655 - protein, 655 aa, ARTIFICIAL SEQUENCE
  Engineered IL-1R-I binding polypeptide
AEAKYAKEVEEIQMEIFRLPNLTRRQYTAFIRKLLDDPSQSSELLSEAKKLSESQAPKASGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1656 - protein, 655 aa, ARTIFICIAL SEQUENCE
  Engineered IL-1R-I binding polypeptide
AEAKYAKEVEEIQMEIFRLPNLNRRQYTAFIRKLLDDPSQSSELLSEAKKLSESQAPKASGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1657 - protein, 749 aa, ARTIFICIAL SEQUENCE
  Engineered IL-1R-I binding polypeptide
AEAKYAKEVEEIQMEIFRLPNLTRRQYTAFIRKLLDDPSQSSELLSEAKKLSESQAPKASGGGGSGGGGSVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 1658 - protein, 86 aa, ARTIFICIAL SEQUENCE
  Engineered IL-1R-I binding polypeptide
AEAKYAKEVEEIQMEIFRLPNLTRRQYTAFIRKLLDDPSQSSELLSEAKKLSESQAPKASGGGGSGGGGSDKTHTCPPCPAPELLG

SEQ ID NO: 1659 - protein, 46 aa, Artificial Sequence
  Engineered albumin binding polypeptide
LAEAKVLANRELDKYGVSDFYKRLINKAKTVEGVEALKLHILAALP

SEQ ID NO: 1660 - protein, 46 aa, STREPTOCOCCUS SP. G148
LAEAKVLANRELDKYGVSDYYKNLINNAKTVEGVKALIDEILAALP

SEQ ID NO: 1661 - protein, 46 aa, ARTIFICIAL SEQUENCE
  Engineered albumin binding polypeptide
LAEAKEAANAELDSYGVSDFYKRLIDKAKTVEGVEALKDAILAALP

SEQ ID NO: 1662 - protein, 227 aa, HOMO SAPIENS
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1663 - protein, 585 aa, HOMO SAPIENS [sequence omitted]

SEQ ID NO: 1664 - protein, 679 aa, HOMO SAPIENS
VPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 1665 - protein, 330 aa, ARTIFICIAL SEQUENCE
  His-tagged target protein
EADKCNEREEKIILVSSANEIDVRPCPLNPNEYKGTITWYKNDSKTPVSTEQASRIHQHKKKLWFVPAKVEDSGHYYCVVRNSSYCLRIKITAKFVENEPNLCYNAEAIFKQRLPVAGDGGLVCPYMEFFKDENNELPKLLWYKDCKPLLLDNIHFSGVKDRLIVMNVAEKHRGNYTCHASYTYLGKQYPITRVIEFITLEENKPTRPVIVSPANETIEVDLGSQIQLICNVTGQLSDTAYWKWNGSFIDEDDPVLGEDYYSVENPANKRRSTLITVLNISETESRFYKHPFTCLARNTHGMDAAYVQLIYPVTGSENLYFQGSHHHHHH

SEQ ID NO: 1666 - protein, 552 aa, CYNOMOLGUS
LEADKCNEREEKIILVSSANEIDVRPCPLNPNEYKGTITWYKNDSKTPVSTEQASRIHQHKKKLWFVPAKVEDSGHYYCVVRNSSYCLRIKITAKFVENEPNLCYNAEAIFKQRLPVAGDGGLVCPYMEFFKDENNELPKLLWYKDCKPLLLDNIHFSGVKDRLIVMNVAEKHRGNYTCHASYTYLGKQYPITRVIEFITLEENKPTRPVIVSPANETIEVDLGSQIQLICNVTGQLSDTAYWKWNGSFIDEDDPVLGEDYYSVENPANKRRSTLITVLNISETESRFYKHPFTCLARNTHGMDAAYVQLIYPVTGSENLYFQGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1667 - protein, 58 aa, ARTIFICIAL SEQUENCE
  Engineered IL-1R-I binding polypeptide
AEAKYAKEAHRAQMEIFALPNLTRRQYTAFIRKLLDDPSQSSELLSEAKKLSESQAPK

SEQ ID NO: 1668 - protein, 58 aa, ARTIFICIAL SEQUENCE
  Engineered IL-1R-I binding polypeptide
AEAKYAKEALSAQQEIFALPNLTRRQYTAFIRKLLDDPSQSSELLSEAKKLSESQAPK

SEQ ID NO: 1669 - protein, 55 aa, ARTIFICIAL SEQUENCE
  Engineered IL-1R-I binding polypeptide
KYAKEAHRAQMEIFALPNLTRRQYTAFIRKLLDDPSQSSELLSEAKKLSESQAPK

SEQ ID NO: 1670 - protein, 58 aa, ARTIFICIAL SEQUENCE
  Engineered IL-1R-I binding polypeptide
AEAKYAKEIEEVQMEIFYLPNLTRRQYTAFIRKLLDDPSQSSELLSEAKKLSESQAPK

SEQ ID NO: 1671 - protein, 58 aa, ARTIFICIAL SEQUENCE
  Engineered IL-1R-I binding polypeptide
AEAKYAKEIEEIQMEIFHLPNLTRRQYTAFIRKLLDDPSQSSELLSEAKKLSESQAPK

SEQ ID NO: 1672 - protein, 58 aa, ARTIFICIAL SEQUENCE
  Engineered IL-1R-I binding polypeptide
AEAKYAKEVEEIQMEIFRLPNLTRRQYTAFIRKLLDDPSQSSELLSEAKKLSESQAPK

SEQ ID NO: 1673 - protein, 58 aa, ARTIFICIAL SEQUENCE
  Engineered IL-1R-I binding polypeptide
AEAKYAKEVEDIQLEIFALPNLTRRQYTAFIRKLLDDPSQSSELLSEAKKLSESQAPK

SEQ ID NO: 1674 - protein, 58 aa, ARTIFICIAL SEQUENCE
  Engineered IL-1R-I binding polypeptide
AEAKYAKELEAIQMEIFHLPNLTRRQYTAFIRKLLDDPSQSSELLSEAKKLSESQAPK

SEQ ID NO: 1675 - protein, 58 aa, ARTIFICIAL SEQUENCE
  Engineered IL-1R-I binding polypeptide
AEAKYAKETEAVQMEIFALPNLTRRQYTAFIRKLLDDPSQSSELLSEAKKLSESQAPK

SEQ ID NO: 1676 - protein, 58 aa, ARTIFICIAL SEQUENCE
  Engineered IL-1R-I binding polypeptide
AEAKYAKEIEEIQMEIFRLPNLTRRQYTAFIRKLLDDPSQSSELLSEAKKLSESQAPK

SEQ ID NO: 1677 - protein, 58 aa, ARTIFICIAL SEQUENCE
  Engineered IL-1R-I binding polypeptide
AEAKYAKELEAIQMEIFYLPNLTRRQYVAFIRKLLDDPSQSSELLSEAKKLSESQAPK

SEQ ID NO: 1678 - protein, 58 aa, ARTIFICIAL SEQUENCE
  Engineered IL-1R-I binding polypeptide
AEAKYAKELEEIQMEIFYLPNLTRRQYTAFIRKLLDDPSQSSELLSEAKKLSESQAPK

SEQ ID NO: 1679 - protein, 58 aa, ARTIFICIAL SEQUENCE
  Engineered IL-1R-I binding polypeptide
AEAKYAKEVEEIQMEIFRLPNLNRRQYTAFIRKLLDDPSQSSELLSEAKKLSESQAPK

SEQ ID NO: 1680 - DNA, 147 bp, ARTIFICIAL SEQUENCE
  Engineered library oligonucleotide
  misc_feature (39)..(47): n is a, c, g, or t
  misc_feature (51)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t
aaataaatctcgaggtagatgccaaatacgccaaagaannnnnnnnngcgnnnnnngagatcnnnnnnctgcctaacctcaccnnnnnncaannnnnngccttcatcnnnaaattannngatgacccaagccagagctcattattta

SEQ ID NO: 1681 - DNA, 147 bp, ARTIFICIAL SEQUENCE
  Engineered library oligonucleotide
  misc_feature (39)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t
aaataaatctcgaggtagatgccaaatacgccaaagaannnnnnnnnnnnnnnnnngagatcnnnnnnctgcctaacctcaccnnnnnncaannnnnngccttcatcnnnaaattannngatgacccaagccagagctcattattta

SEQ ID NO: 1682 - DNA, 147 bp, ARTIFICIAL SEQUENCE; identical to SEQ ID NO: 1681
  Engineered library oligonucleotide
  misc_feature (39)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t

SEQ ID NO: 1683 - protein, 10 aa, ARTIFICIAL SEQUENCE
  Linker
GGGGSGGGGS

SEQ ID NO: 1684 - protein, 12 aa, ARTIFICIAL SEQUENCE
  Linker
ASGGGGSGGGGS

SEQ ID NO: 1685 - protein, 40 aa, ARTIFICIAL SEQUENCE
  Linker
KEAAAKEAAAKEAAAKELAAKEAAAKEAAAKEAAAKELAA

SEQ ID NO: 1686 - protein, 29 aa, ARTIFICIAL SEQUENCE
  Engineered IL-1R-I binding polypeptide
  misc_feature (2)..(7): Xaa can be any naturally occurring amino acid
  misc_feature (10)..(11): Xaa can be any naturally occurring amino acid
  misc_feature (16)..(16): Xaa can be any naturally occurring amino acid
  misc_feature (18)..(18): Xaa can be any naturally occurring amino acid
  misc_feature (21)..(21): Xaa can be any naturally occurring amino acid
  misc_feature (25)..(26): Xaa can be any naturally occurring amino acid
  misc_feature (28)..(28): Xaa can be any naturally occurring amino acid
EXXXXXXEIXXLPNLXRXQYXAFIXXLXD

SEQ ID NO: 1687 - protein, 49 aa, ARTIFICIAL SEQUENCE
  Engineered IL-1R-I binding polypeptide
  misc_feature (3)..(8): Xaa can be any naturally occurring amino acid
  misc_feature (11)..(12): Xaa can be any naturally occurring amino acid
  misc_feature (17)..(17): Xaa can be any naturally occurring amino acid
  misc_feature (19)..(19): Xaa can be any naturally occurring amino acid
  misc_feature (22)..(22): Xaa can be any naturally occurring amino acid
  misc_feature (26)..(27): Xaa can be any naturally occurring amino acid
  misc_feature (29)..(29): Xaa can be any naturally occurring amino acid
  misc_feature (36)..(37): Xaa can be any naturally occurring amino acid
  misc_feature (40)..(40): Xaa can be any naturally occurring amino acid
  misc_feature (46)..(48): Xaa can be any naturally occurring amino acid
KEXXXXXXEIXXLPNLXRXQYXAFIXXLXDDPSQSXXLLXEAKKLXXXQ

SEQ ID NO: 1688 - protein, 53 aa, ARTIFICIAL SEQUENCE
  Engineered IL-1R-I binding polypeptide
  misc_feature (5)..(10): Xaa can be any naturally occurring amino acid
  misc_feature (13)..(14): Xaa can be any naturally occurring amino acid
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
  misc_feature (28)..(29): Xaa can be any naturally occurring amino acid
  misc_feature (31)..(31): Xaa can be any naturally occurring amino acid
  misc_feature (38)..(39): Xaa can be any naturally occurring amino acid
  misc_feature (42)..(42): Xaa can be any naturally occurring amino acid
  misc_feature (48)..(50): Xaa can be any naturally occurring amino acid
YAKEXXXXXXEIXXLPNLXRXQYXAFIXXLXDDPSQSXXLLXEAKKLXXXQAP

SEQ ID NO: 1689 - protein, 53 aa, ARTIFICIAL SEQUENCE
  Engineered IL-1R-I binding polypeptide
  misc_feature (5)..(10): Xaa can be any naturally occurring amino acid
  misc_feature (13)..(14): Xaa can be any naturally occurring amino acid
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
  misc_feature (28)..(29): Xaa can be any naturally occurring amino acid
  misc_feature (31)..(31): Xaa can be any naturally occurring amino acid
  misc_feature (38)..(39): Xaa can be any naturally occurring amino acid
  misc_feature (42)..(42): Xaa can be any naturally occurring amino acid
  misc_feature (48)..(50): Xaa can be any naturally occurring amino acid
FNKEXXXXXXEIXXLPNLXRXQYXAFIXXLXDDPSQSXXLLXEAKKLXXXQAP

SEQ ID NO: 1690 - protein, 53 aa, ARTIFICIAL SEQUENCE
  Engineered IL-1R-I binding polypeptide
  misc_feature (5)..(10): Xaa can be any naturally occurring amino acid
  misc_feature (13)..(14): Xaa can be any naturally occurring amino acid
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
  misc_feature (28)..(29): Xaa can be any naturally occurring amino acid
  misc_feature (31)..(31): Xaa can be any naturally occurring amino acid
  misc_feature (42)..(42): Xaa can be any naturally occurring amino acid
FNKEXXXXXXEIXXLPNLXRXQYXAFIXXLXDDPSQSANLLXEAKKLNDAQAP

SEQ ID NO: 1691 - protein, 53 aa, ARTIFICIAL SEQUENCE
  Engineered IL-1R-I binding polypeptide
  misc_feature (5)..(10): Xaa can be any naturally occurring amino acid
  misc_feature (13)..(14): Xaa can be any naturally occurring amino acid
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
  misc_feature (28)..(29): Xaa can be any naturally occurring amino acid
  misc_feature (31)..(31): Xaa can be any naturally occurring amino acid
  misc_feature (42)..(42): Xaa can be any naturally occurring amino acid
FAKEXXXXXXEIXXLPNLXRXQYXAFIXXLXDDPSQSSELLXEAKKLSESQAP

SEQ ID NO: 1692 - protein, 53 aa, ARTIFICIAL SEQUENCE
  Engineered IL-1R-I binding polypeptide
  misc_feature (5)..(10): Xaa can be any naturally occurring amino acid
  misc_feature (13)..(14): Xaa can be any naturally occurring amino acid
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
  misc_feature (28)..(29): Xaa can be any naturally occurring amino acid
  misc_feature (31)..(31): Xaa can be any naturally occurring amino acid
  misc_feature (42)..(42): Xaa can be any naturally occurring amino acid
FAKEXXXXXXEIXXLPNLXRXQYXAFIXXLXDDPSQSSELLXEAKKLNDSQAP

SEQ ID NO: 1693 - protein, 53 aa, ARTIFICIAL SEQUENCE
  Engineered IL-1R-I binding polypeptide
  misc_feature (5)..(10): Xaa can be any naturally occurring amino acid
  misc_feature (13)..(14): Xaa can be any naturally occurring amino acid
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
  misc_feature (28)..(29): Xaa can be any naturally occurring amino acid
  misc_feature (31)..(31): Xaa can be any naturally occurring amino acid
  misc_feature (42)..(42): Xaa can be any naturally occurring amino acid
  misc_feature (48)..(49): Xaa can be any naturally occurring amino acid
YAKEXXXXXXEIXXLPNLXRXQYXAFIXXLXDDPSQSSELLXEAKKLXXSQAP

SEQ ID NO: 1694 - protein, 54 aa, ARTIFICIAL SEQUENCE
  Engineered IL-1R-I binding polypeptide
  misc_feature (6)..(11): Xaa can be any naturally occurring amino acid
  misc_feature (14)..(15): Xaa can be any naturally occurring amino acid
  misc_feature (20)..(20): Xaa can be any naturally occurring amino acid
  misc_feature (22)..(22): Xaa can be any naturally occurring amino acid
  misc_feature (25)..(25): Xaa can be any naturally occurring amino acid
  misc_feature (29)..(30): Xaa can be any naturally occurring amino acid
  misc_feature (32)..(32): Xaa can be any naturally occurring amino acid
  misc_feature (43)..(43): Xaa can be any naturally occurring amino acid
  misc_feature (49)..(50): Xaa can be any naturally occurring amino acid
KYAKEXXXXXXEIXXLPNLXRXQYXAFIXXLXDDPSQSSELLXEAKKLXXSQAP

SEQ ID NO: 1695 - protein, 58 aa, ARTIFICIAL SEQUENCE
  Engineered IL-1R-I binding protein
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
ADNNFNKEXXXXXXEIXXLPNLXRXQYXAFIXXLXDDPSQSANLLSEAKKLNESQAPK

SEQ ID NO: 1696 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
ADNKFNKEXXXXXXEIXXLPNLXRXQYXAFIXXLXDDPSQSANLLAEAKKLNDAQAPK

SEQ ID NO: 1697 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
ADNKFNKEXXXXXXEIXXLPNLXRXQYXAFIXXLXDDPSVSKEILAEAKKLNDAQAPK

SEQ ID NO: 1698 - protein, 61 aa, ARTIFICIAL SEQUENCE
  Engineered IL-1R-I binding polypeptide
  misc_feature (12)..(17): Xaa can be any naturally occurring amino acid
  misc_feature (20)..(21): Xaa can be any naturally occurring amino acid
  misc_feature (26)..(26): Xaa can be any naturally occurring amino acid
  misc_feature (28)..(28): Xaa can be any naturally occurring amino acid
  misc_feature (31)..(31): Xaa can be any naturally occurring amino acid
  misc_feature (35)..(36): Xaa can be any naturally occurring amino acid
  misc_feature (38)..(38): Xaa can be any naturally occurring amino acid
ADAQQNNFNKEXXXXXXEIXXLPNLXRXQYXAFIXXLXDDPSQSTNVLGEAKKLNESQAPK

SEQ ID NO: 1699 - protein, 56 aa, ARTIFICIAL SEQUENCE
  Engineered IL-1R-I binding polypeptide
  misc_feature (7)..(12): Xaa can be any naturally occurring amino acid
  misc_feature (15)..(16): Xaa can be any naturally occurring amino acid
  misc_feature (21)..(21): Xaa can be any naturally occurring amino acid
  misc_feature (23)..(23): Xaa can be any naturally occurring amino acid
  misc_feature (26)..(26): Xaa can be any naturally occurring amino acid
  misc_feature (30)..(31): Xaa can be any naturally occurring amino acid
  misc_feature (33)..(33): Xaa can be any naturally occurring amino acid
AQHDEEXXXXXXEIXXLPNLXRXQYXAFIXXLXDDPSQSANVLGEAQKLNDSQAPK

SEQ ID NO: 1700 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDNKFNKEXXXXXXEIXXLPNLXRXQYXAFIXXLXDDPSQSANLLAEAKKLNDAQAPK

SEQ ID NO: 1701 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSESSELLSEAKKLNKSQAPK

SEQ ID NO: 1702 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLAEAKKLNDAQAPK

SEQ ID NO: 1703 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLAEAKKLNDSQAPK

SEQ ID NO: 1704 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLSEAKKLNDSQAPK

SEQ ID NO: 1705 - protein, 57 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLSEAKKLNDSQAP

SEQ ID NO: 1706 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKFAKEXXXXXXEIXXLPNLXRXQYXAFIXXLXDDPSQSSELLSEAKKLNDSQAPK

SEQ ID NO: 1707 - protein, 57 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKFAKEXXXXXXEIXXLPNLXRXQYXAFIXXLXDDPSQSSELLSEAKKLNDSQAP

SEQ ID NO: 1708 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLAEAKKLNDAQAPK

SEQ ID NO: 1709 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLSEAKKLSESQAPK

SEQ ID NO: 1710 - protein, 57 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLSEAKKLSESQAP

SEQ ID NO: 1711 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKFAKEXXXXXXEIXXLPNLXRXQYXAFIXXLXDDPSQSSELLSEAKKLSESQAPK

SEQ ID NO: 1712 - protein, 57 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKFAKEXXXXXXEIXXLPNLXRXQYXAFIXXLXDDPSQSSELLSEAKKLSESQAP

SEQ ID NO: 1713 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLAEAKKLSEAQAPK

SEQ ID NO: 1714 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLSEAKKLESSQAPK

SEQ ID NO: 1715 - protein, 57 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLSEAKKLESSQAP

SEQ ID NO: 1716 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLAEAKKLESAQAPK

SEQ ID NO: 1717 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLSEAKKLSDSQAPK

SEQ ID NO: 1718 - protein, 57 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLSEAKKLSDSQAP

SEQ ID NO: 1719 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLAEAKKLSDSQAPK

SEQ ID NO: 1720 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLAEAKKLSDAQAPK

SEQ ID NO: 1721 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLSEAKKLNDSQAPK

SEQ ID NO: 1722 - protein, 58 aa, ARTIFICIAL SEQUENCE; identical to SEQ ID NO: 1702
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid

SEQ ID NO: 1723 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLSEAKKLSESQAPK

SEQ ID NO: 1724 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLAEAKKLSEAQAPK

SEQ ID NO: 1725 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLSEAKKLESSQAPK

SEQ ID NO: 1726 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLAEAKKLESAQAPK

SEQ ID NO: 1727 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLSEAKKLSDSQAPK

SEQ ID NO: 1728 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLAEAKKLSDSQAPK

SEQ ID NO: 1729 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLAEAKKLSDAQAPK

SEQ ID NO: 1730 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
VDAKYAKEXXXXXXEIXXLPNLXRXQYXAFIXXLXDDPSQSSELLAEAKKLNKAQAPK

SEQ ID NO: 1731 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
AEAKYAKEXXXXXXEIXXLPNLXRXQYXAFIXXLXDDPSQSSELLAEAKKLNKAQAPK

SEQ ID NO: 1732 - protein, 58 aa, ARTIFICIAL SEQUENCE
  Engineered IL-1R-I binding polypeptide
  misc_feature (9)..(14): Xaa can be any naturally occurring amino acid
  misc_feature (17)..(18): Xaa can be any naturally occurring amino acid
  misc_feature (23)..(23): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(33): Xaa can be any naturally occurring amino acid
  misc_feature (35)..(35): Xaa can be any naturally occurring amino acid
ADAKYAKEXXXXXXEIXXLPNLXRXQYXAFIXXLXDDPSQSSELLSEAKKLNDSQAPK

SEQ ID NO: 1733 - protein, 155 aa, ARTIFICIAL SEQUENCE
  Control polypeptide
GSAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 1734 - protein, 297 aa, Artificial Sequence
  Engineered IL-1R-I binding polypeptide
AEAKYAKEVEEIQMEIFRLPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1735 - protein, 297 aa, Artificial Sequence
  Engineered IL-1R-I binding polypeptide
AEAKYAKEVEEIQMEIFRLPNLTRRQYTAFIRKLLDDPSQSSELLSEAKKLSESQAPKASGGGGSGGGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1736 - protein, 297 aa, Artificial Sequence
  Engineered IL-1R-I binding polypeptide
AEAKYAKEVEEIQMEIFRLPNLTRRQYTAFIRKLLDDPSQSSELLSEAKKLSESQAPKASGGGGSGGGGSDKTHTCPPCPAPELLGGPSVFLFPPKPKDTLYITREPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1737 - protein, 299 aa, Artificial Sequence
  Engineered IL-1R-I binding polypeptide
AEAKYAKEVEEIQMEIFRLPNLTRRQYTAFIRKLLDDPSQSSELLSEAKKLSESQAPKASGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

The invention claimed is:

1. An IL-1R-I binding polypeptide, comprising an IL-1R-I binding motif BM, which motif consists of the amino acid sequence:

(SEQ ID NO: 1686)

$EX_2X_3X_4X_5X_6X_7EIX_{10}X_{11}LPNLX_{16}RX_{18}QYX_{21}AFIX_{25}X_{26}LX_{28}D$ (i)

wherein $X_2$ is selected from A, I, L, T and V;

$X_3$ is selected from E and Y;
$X_4$ is selected from A, E, I, K, Q, R, T, V and Y;
$X_5$ is selected from I and V;
$X_6$ is selected from Q and Y;
$X_7$ is selected from F and M;
$X_{10}$ is selected from F and Y;
$X_{11}$ is selected from A, D, E, F, G, H, K, L, Q, R, S, T, V and Y;
$X_{16}$ is selected from N and T;
$X_{18}$ is selected from K and R;
$X_{21}$ is selected from T and V;
$X_{25}$ is selected from I and R;

$X_{26}$ is selected from K and S, and $X_{28}$ is selected from F and L, and wherein said IL-1R-I binding motif forms part of a three-helix bundle protein domain.

2. The IL-1R-I binding polypeptide according to claim 1, wherein $X_3$ is E, $X_{21}$ is T, and/or $X_{25}$ is R.

3. The IL-1R-I binding polypeptide according to claim 1, wherein $X_6X_{10}$ is selected from the group consisting of QF, QY, YF and YY.

4. The IL-1R-I binding polypeptide according to claim 3, wherein $X_6X_{10}$ is QF.

5. The IL-1R-I binding polypeptide according to claim 1, wherein $X_{18}X_{25}X_{28}$ is KRL or RRL.

6. The IL-1R-I binding polypeptide according to claim 5, wherein $X_{18}X_{25}X_{28}$ is RRL.

7. The IL-1R-I binding polypeptide according to claim 1, wherein $X_5X_7$ is IM or VM.

8. The IL-1R-I binding polypeptide according to claim 1, which comprises an amino acid sequence selected from:

```
a)
                                    (SEQ ID NO: 1721)
VDAKYAK-[BM]-DPSQSSELLSEAKKLNDSQAPK
and b)
                                    (SEQ ID NO: 1709)
AEAKYAK-[BM]-DPSQSSELLSEAKKLSESQAPK.
```

9. The IL-1R-I binding polypeptide according to claim 8, comprising an amino acid sequence selected from the group consisting of SEQ ID NO:1-1632, 1667-1668 and 1670-1679.

10. The IL-1R-I binding polypeptide according to claim 8, comprising an amino acid sequence selected from the group consisting of SEQ ID NO:1206-1632, 1667-1668 and 1670-1679.

11. The IL-1R-I binding polypeptide according to claim 8, comprising an amino acid sequence selected from the group consisting of SEQ ID NO:1252, 1285, 1307, 1308, 1328, 1331, 1415, 1421, 1435, 1594 and 1670-1679.

12. The IL-1R-I binding polypeptide according to claim 1, which comprises a binding module BMod comprising the amino acid sequence

```
                                    (SEQ ID NO: 1687)
K-[BM]-DPSQSXaXbLLXcEAKKLXdXeXfQ;
``` wherein

Xa is selected from A and S;

Xb is selected from N and E;

Xc is selected from A, S and C;

Xd is selected from E, N and S;

Xe is selected from D, E and S; and

Xf is selected from A and S.

13. The IL-1R-I binding polypeptide according to claim 1, which comprises an amino acid sequence selected from:

```
                                    SEQ ID NO: 1695
ADNNFNK-[BM]-DPSQSANLLSEAKKLNESQAPK;

SEQ ID NO: 1696
ADNKFNK-[BM]-DPSQSANLLAEAKKLNDAQAPK;

SEQ ID NO: 1697
ADNKFNK-[BM]-DPSVSKEILAEAKKLNDAQAPK;

SEQ ID NO: 1698
ADAQQNNFNK-[BM]-DPSQSTNVLGEAKKLNESQAPK;

SEQ ID NO: 1699
AQHDE-[BM]-DPSQSANVLGEAQKLNDSQAPK;

SEQ ID NO: 1700
VDNKFNK-[BM]-DPSQSANLLAEAKKLNDAQAPK;

SEQ ID NO: 1701
AEAKYAK-[BM]-DPSESSELLSEAKKLNKSQAPK;

SEQ ID NO: 1702
VDAKYAK-[BM]-DPSQSSELLAEAKKLNDAQAPK;

SEQ ID NO: 1703
VDAKYAK-[BM]-DPSQSSELLAEAKKLNDSQAPK;

SEQ ID NO: 1704
AEAKYAK-[BM]-DPSQSSELLSEAKKLNDSQAPK;

SEQ ID NO: 1705
AEAKYAK-[BM]-DPSQSSELLSEAKKLNDSQAP;

SEQ ID NO: 1706
AEAKFAK-[BM]-DPSQSSELLSEAKKLNDSQAPK;

SEQ ID NO: 1707
AEAKFAK-[BM]-DPSQSSELLSEAKKLNDSQAP;

SEQ ID NO: 1708
AEAKYAK-[BM]-DPSQSSELLAEAKKLNDAQAPK;

SEQ ID NO: 1709
AEAKYAK-[BM]-DPSQSSELLSEAKKLSESQAPK;

SEQ ID NO: 1710
AEAKYAK-[BM]-DPSQSSELLSEAKKLSESQAP;

SEQ ID NO: 1711
AEAKFAK-[BM]-DPSQSSELLSEAKKLSESQAPK;

SEQ ID NO: 1712
AEAKFAK-[BM]-DPSQSSELLSEAKKLSESQAP;

SEQ ID NO: 1713
AEAKYAK-[BM]-DPSQSSELLAEAKKLSEAQAPK;

SEQ ID NO: 1714
AEAKYAK-[BM]-DPSQSSELLSEAKKLESSQAPK;
```

```
                            SEQ ID NO: 1715
AEAKYAK-[BM]-DPSQSSELLSEAKKLESSQAP;

SEQ ID NO: 1716
AEAKYAK-[BM]-DPSQSSELLAEAKKLESAQAPK;

SEQ ID NO: 1717
AEAKYAK-[BM]-DPSQSSELLSEAKKLSDSQAPK;

SEQ ID NO: 1718
AEAKYAK-[BM]-DPSQSSELLSEAKKLSDSQAP;

SEQ ID NO: 1719
AEAKYAK-[BM]-DPSQSSELLAEAKKLSDSQAPK;

SEQ ID NO: 1720
AEAKYAK-[BM]-DPSQSSELLAEAKKLSDAQAPK;

SEQ ID NO: 1721
VDAKYAK-[BM]-DPSQSSELLSEAKKLNDSQAPK;

SEQ ID NO: 1722
VDAKYAK-[BM]-DPSQSSELLAEAKKLNDAQAPK;

SEQ ID NO: 1723
VDAKYAK-[BM]-DPSQSSELLSEAKKLSESQAPK;

SEQ ID NO: 1724
VDAKYAK-[BM]-DPSQSSELLAEAKKLSEAQAPK;

SEQ ID NO: 1725
VDAKYAK-[BM]-DPSQSSELLSEAKKLESSQAPK;

SEQ ID NO: 1726
VDAKYAK-[BM]-DPSQSSELLAEAKKLESAQAPK;

SEQ ID NO: 1727
VDAKYAK-[BM]-DPSQSSELLSEAKKLSDSQAPK;

SEQ ID NO: 1728
VDAKYAK-[BM]-DPSQSSELLAEAKKLSDSQAPK;

SEQ ID NO: 1729
VDAKYAK-[BM]-DPSQSSELLAEAKKLSDAQAPK;

SEQ ID NO: 1730
VDAKYAK-[BM]-DPSQSSELLAEAKKLNKAQAPK;

SEQ ID NO: 1731
AEAKYAK-[BM]-DPSQSSELLAEAKKLNKAQAPK,
and

SEQ ID NO: 1732
ADAKYAK-[BM]-DPSQSSELLSEAKKLNDSQAPK.
```

14. The IL-1R-I binding polypeptide according to claim 1, which blocks the interaction of IL-1R-I with IL-1 cytokines.

15. The IL-1R-I binding polypeptide according to claim 1, which binds to IL-1R-I with a $K_D$ value of at most $1\times10^{-6}$ M.

16. A composition comprising the IL-1R-I binding polypeptide-according to claim 1 and at least one pharmaceutically acceptable excipient or carrier.

17. A fusion protein or conjugate comprising
 a first moiety consisting of the IL-1R-I binding polypeptide according to claim 1; and
 a second moiety consisting of a polypeptide having a desired biological activity.

18. The fusion protein or conjugate according to claim 17, wherein said desired biological activity is increasing in vivo half-life of the IL-IR-I binding polypeptide.

19. The fusion protein or conjugate according to claim 17, wherein said second moiety is selected from the group consisting of: the albumin binding domain of streptococcal protein G or a derivative thereof; serum albumin; an Fc portion of an antibody, and transferrin.

20. The fusion protein or conjugate according to claim 19, wherein said second moiety is an Fc portion of an antibody.

21. The fusion protein or conjugate according to claim 17, comprising a polypeptide having an amino acid sequence selected from the group consisting of SEQ ID NO:1639-1658 and 1734-1737.

22. A composition comprising the fusion protein or conjugate according to claim 17 and at least one pharmaceutically acceptable excipient or carrier.

23. An IL-1R-I binding polypeptide, comprising an IL-1R-I binding motif BM, wherein the BM consists of amino acids 8-36 of a sequence selected from the group consisting of SEQ ID NO: 1-1632, and 1679.

24. The IL-1R-I binding polypeptide according to claim 23, wherein the BM consists of amino acids 8-36 of a sequence selected from the group consisting of SEQ ID NO: 1206-1632 and 1679.

25. The IL-1R-I binding polypeptide according to claim 23, wherein the BM consists of amino acids 8-36 of a sequence selected from the group consisting of SEQ ID NO:1252, 1285, 1307, 1308, 1328, 1331, 1415, 1421, 1435, 1594 and 1679.

* * * * *